United States Patent
Philippe et al.

(10) Patent No.: US 12,351,849 B2
(45) Date of Patent: Jul. 8, 2025

(54) MICROBIAL PRODUCTION OF TRITERPENOIDS INCLUDING MOGROSIDES

(71) Applicant: Manus Bio, Inc., Cambridge, MA (US)

(72) Inventors: Ryan Philippe, Cambridge, MA (US); Ajikumar Parayil Kumaran, Cambridge, MA (US); Christine Nicole S. Santos, Cambridge, MA (US); Michelle N. Goettge, Cambridge, MA (US)

(73) Assignee: Manus Bio Inc., Waltham, MA (US)

( * ) Notice: Subject to any disclaimer, the term of this patent is extended or adjusted under 35 U.S.C. 154(b) by 1073 days.

(21) Appl. No.: 16/971,740

(22) PCT Filed: Feb. 27, 2019

(86) PCT No.: PCT/US2019/019886
§ 371 (c)(1),
(2) Date: Aug. 21, 2020

(87) PCT Pub. No.: WO2019/169027
PCT Pub. Date: Sep. 6, 2019

(65) Prior Publication Data
US 2021/0032669 A1 Feb. 4, 2021

Related U.S. Application Data

(60) Provisional application No. 62/635,751, filed on Feb. 27, 2018.

(51) Int. Cl.
| C12N 1/13 | (2006.01) |
| C12P 5/00 | (2006.01) |
| C12P 19/60 | (2006.01) |
| C12N 9/90 | (2006.01) |

(52) U.S. Cl.
CPC ............... C12P 19/60 (2013.01); C12P 5/007 (2013.01); C12N 9/90 (2013.01)

(58) Field of Classification Search
CPC ...... C12N 9/90; C12N 15/63; C12N 15/8243; C12N 15/70; C12N 9/1022; C12N 9/1205; C12N 9/1229; C12P 5/007; C12P 23/00; C12Y 205/01068; C12Y 205/01021; C12Y 303/0201; C12Y 114/99007; C12Y 205/01092
USPC ............................................ 435/67, 193, 52
See application file for complete search history.

(56) References Cited

U.S. PATENT DOCUMENTS

2015/0322473 A1* 11/2015 Liu et al.
2017/0283844 A1 10/2017 Itkin et al.

FOREIGN PATENT DOCUMENTS

| CN | 107109377 A | 8/2017 |
| WO | 2016/029187 | 2/2016 |
| WO | 2016038617 A1 | 3/2016 |

OTHER PUBLICATIONS

Kisselev L., (Structure, 2002, vol. 10: 8-9.*
Kwiatkowski et al., (Biochemistry 38:11643-11650, 1999.*
Wristlock et al., (Quarterly Reviews of Biophysics 2003, vol. 36 (3): 307-340.*
Davos et al., (Proteins: Structure, Function and Genetics, 2000, vol. 41: 98-107.*
Ghimire et al. Improved Squalene Production via Modulation of the Methylerythritof 4-Phosphate Pathway and Heterologous Expression of Genes from *Streptomyces peucetius* ATCC 27952 in *Escherichia coli*, Applied and Environmental Microbiology, Nov. 2009, vol. 75, No. 22, pp. 7291-7293.
K7NBW9_SIRGR, UniProtKB Accession No. K7NBW9_SIRGR, Squalene synthase, Feb. 6, 2013 [online]. (Retrieved on Aug. 1, 2019). Retrieved from the internet <URL: https://www .uniprot. org/uniproUK7NBW9> Entire document.
International Search Report and Written Opinion for International Application No. PCT/US2019/019886 , dated Aug. 28, 2019, 14 pages.
Database Uniport [Online], Nov. 22, 2017. Zeng, Ra et al. Squalene Synthase from Artemisia Annua. XP055878955, Database accession No. Q6SYC8.
GenPept, "squalene synthase [*Siraitia grosvenorii*]", GenBank: AEM42980.1. (2 Pages), 2023.
GenPept, "squalene synthase [*Artemisia annua*]", GenBank: AAR20329. 1. (2 Pages), 2004.

* cited by examiner

*Primary Examiner* — Robert B Mondesi
*Assistant Examiner* — Mohammad Y Meah
(74) *Attorney, Agent, or Firm* — Morgan, Lewis & Bockius LLP

(57) ABSTRACT

The present invention provides host cells and methods for making mogrol glycosides, including Mogroside V (Mog. V), Mogroside VI (Mog. VI), Iso-Mogroside V (Isomog. V), and glycosylation products that are minor products in *Siraitia grosvenorii*. The invention provides engineered enzymes and engineered host cells for producing mogrol glycosylation products, such as Mog. V, Mog. VI, and Isomog. V, at high purity and/or yield. The present technology further provides methods of making products containing mogrol glycosides, such as Mog. V, Mog. VI, and Isomog. V, including food products, beverages, oral care products, sweeteners, and flavoring products.

17 Claims, 13 Drawing Sheets

Specification includes a Sequence Listing.

FIG. 10:

```
CaUGT_1,6     ------MEMHATFRVLMLPMLAHGMVSPYLELAKKLTARHFRVYLCSSPATLSSVRSKLTEKF  57
SgUGT94_289_3 MEAAQQQDTTTILMLPWLGYGHLSAFLELAKSLSRRNFHIYFCSTSVWLQAIKPKLPSSF   60
              :: *:.:****:* : *:: * ****.***:.:..:*:*.:**:  : .:: :**.*

CaUGT_1,6     SQSIHLVELHLPKLPELPAEYHTTNGLPPHLPPTLKDAPKPECIWLKSLKPDLLIY       117
SgUGT94_289_3 SDSIQFVELHLPSSDEFPPHLHTNGLPPTLNPALHQMFSNAAQHFESILQTLAPHLLIY   120
              *:** :*******. :*:**:**.****:*:  *:: :*. .*::*::**:*::**:*

CaUGT_1,6     DLLQPMAPEAASAFHIPAVVFISSSATMTSFGLHFFKMPGTKYPYGMAIFYRDYESVFVE    177
SgUGT94_289_3 DSLQPMAPRVASSLKIPAINFHTTGVFVISQGXHPIHYPASKFPFSEPVLHNMRKAMYST   180
              * *******..**::.***:* ::*.*:*  :*: .:* .*  *. :* .:...*

CaUGT_1,6     NL------TRRDRDTYRVTNCMERSSKTILKGFNETEGKYPDYFSCLTGKKVVPVGPLVQD  233
SgUGT94_289_3 ADGASTERTRKRGEAFLYCLHASCSVILNSFRELEGKYMDYLSVLIRKKVVPVGPLVYE   240
              ::   **: *:  : : .: :.**:** .*.:**** **:*. *.****.*****::

CaUGT_1,6     PVLDDED--CRIMQNLIKKERGSTVFVSFGSEYFLSKQMEELAHGLEVSHVDFIKVVR    290
SgUGT94_289_3 PIKQGEDEGVSSIKHMLOKKEPSSTVFVSFGSEYFPSKEEMEELAHGLEASEVHFIKVVR   300
              *: ..**    .*:::*:*** *:*********** **:*:******:*:.:.*****

CaUGT_1,6     FPKGEHI-VIEETLPKGFFERYGERGLVVHGMAPQGAKILTHPNVGGFVSHCGMRSVMESM  349
SgUGT94_289_3 FPQQDHTSGIEDALPKGFLERAGERGMVVKGWAPQGAKILKHVSTCGFVSHCGWRSVMESH  360
              **: ::  :*:: ****:**.****:**:*:******:* : . *********:*****

CaUGT_1,6     KFGLPIIAMPMHLDQPINARLIEEVGAAGVEVLRDSKGKHLMERMAEETIHKVVKEASGESV 409
SgUGT94_289_3 NFGVPIIGVPMMVDQPFHAGLYEEAGGVGVEAKROPDGKTQPDEVAELIKEVVEKTREDV  420
              :**:***.:** :***::* * **.*.***  *.  ** ::*:.**:*::**:*: :.*

CaUGT_1,6     RKKARELQEKLELKGDEEIDDVVKELVQLCATKNKRKGLHYY    451
SgUGT94_289_3 RKKAREMSEILRSKGEEKFDEMVAEISLLLEI---------   452
              ******:.*: ::** *: *::*.*:. *
```

FIG. 11:

```
HsSQS  -MEFVKCLGHPEEFYNLVRFRIGGKRKVMPKMDQDSLSSSLKTCYKYLNQTSRSFAAVIQ    59
AaSQS  MSSLKAVLKHPDFYPLLKLKMAAKRAEKQIP---SQPHWAFSYSMLHKVSRSFALVIQ      56
         *  **;;** *;;;;;;*;              *   *;******  ***

HsSQS  ALDGEMRNAVCIFYLVLRALDTLEDDMTISVEKKVPLLHNFHSFLYQPDWRFMESKEKDR   119
AaSQS  QLMPQLRDAVCIFYLVLRALDTIVEDDTSIAADIKVPILIAFHKHIYNRDWHFACGTKEYK  116
        *;;;;*********** ** **** * *;*  **;* * * ;*;  * *;

HsSQS  QVLEDFPTISLEFRNLAEKYQTVIADICRRMGIGMAEFLDKHVTSEQEWDKYCHYVAGLV   179
AaSQS  VLMDQFHHVSTAFLELKRGYQEAIEDITMRMGAGMAKFICKEVETVDDYDEYCHYVAGLV   176
        ;;;; ;; ;;  **;  ** *** **;*  **;*;* *;  *;*;  **********

HsSQS  GIGLSRLFSASEFEDPLVGEDTERANSMGLFLQKTNIIRDYLEDQQ---GGREFWPQEVW  236
AaSQS  GIGLSKLFHSSGTEILF---SDSISNSMGLFLQKTNIIRDYLEDINEIPKSRMFWPREIW  233
       *****;;** ;;  **  ;  *;*;********************; *; ***  *;*

HsSQS  SRYVKKLGDFAKPENIDLAVQCLNELITNALHHIPDVITYLSRLRNQSVFNFCAIPQVMA  296
AaSQS  SKYVNKLEDLKYEENSEKAVQCLNDMVTNALIHIEDCLKYMSQLKDPAIFRFCAIPQIMA  293
       *;**;** *    *;  ; **** ; ****; * *  ;;;;;;;  **;******;**

HsSQS  IATLAACYNNQQVFKGAVKIRKGQAVTLMMDATNMPAVKAIIYQVMEETYHRIPDSDPSS  356
AaSQS  IGTLALCYNNIEVFRGVVKLRRGLTAKVIDRTKTMADVYQAFSDFSDMLKSKVDMHDPNA  353
       *;*** ****  ** ;;* ;;* ;;;;;;; ;;;*; ** ;  ; ;;;    ;; * ;

HsSQS  SKTRQIISTIRT-----QMLPMCQLISRSHYSPIYLSFVMLLAALSWQYLTTLSQVT    408
AaSQS  QTTITRLEAAQKICKDSGTLSMRKSYIVKRESSYSAALLALLFTILAILYAYLSAMRPNK  413
         ;  ;;  ;         ;; ; ;;  ; **   *;  ** ;;; ;;;;;

HsSQS  EDYVQTGEH    417
AaSQS  IKFTL----    418
        ;;
```

FIG. 12:

```
HsSQE    MLEFHFEGEEQPLSMMKKFLKSSMMRIGFVPEEERNVLRRRKGINISETSLIGTAACTST    60
MlSQE    ------------------------------------------------------------    0

HsSQE    SSQMDPEVITVGAGVLGSALAAVLSRDGRKVTVIERDLKEPDRIVGEFLQPGGYHVLKDL    120
MlSQE    -MKEEFDICIIGAGMAGATISAYLAPKGIKIALIDHCYKEKKRIVGELLQPGAVLSLEQM    59
              ;;*;***; ** ;*  *,*  ;;;*;  **   *****;****  , *  ;; *;

HsSQE    GLGDTVEGLDAQVVWGYMIHDQESKSEVQIPYPLSEMMQVQSGRAFHHGRFIMSLRKAAM    180
MlSQE    GLSHLLDGFEAQTVKGYALLQGNEKT---TIPYPSQ------HEGIGLHMGRFLQQIRASAL   112
         **.,  ;*;;** *;;**  ;;    *;    ****    .    *;  ;****;  ;;  *;

HsSQE    AEPNAKFIEGVVLQLLEE-DDVVMGVQYRDKETGDIKELHAPLTVVADGLFSKFRKSLVS    239
MlSQE    ENSSVTQIMGKALQLLENERNEIIGVSYRESITSQIKSIYAPLTITSDGFFSMFRAHLSN    172
          ;    *,  ,******;  ;  ;;**,*;;    *  ;*;;****;.;**;;** *  ,

HsSQE    NKVSVSSHFVGFLPKNAPQFKAMHAELILANPSPVLIYQISSSETRVLVDIRGEMPR---    296
MlSQE    MQKTVTSYFIGLILKDCEMPFPKHGHVFLSGPTPFICYPISDMEVRLLIDFPGEQLPRKN    232
         * ; ; **;*** ;;*;  ,  ;;  ;;**; *;  *  ;;*;; * **  ,.*;;***  **

HsSQE    NLREYPMVEKTYPQIPDHLKEPFLEATDMSHLRSMPASFLPPSSVKKRGVLLLGDAYNMRH    356
MlSQE    LLQEHLDTNVTPYIPECMRSSYAQAIQEGGFKVMPWHYMAAKPIVRKGAVMLGDALNMRH    292
          *;;*;;  ;;  *;;**;;; ;;    *;;  **  ;;     *; ;; **  ;;****  ****

HsSQE    PLTGGGMTVAFKDIKLWRKLLKGIPDLYDDAAIFEAKKSFYMARKTSHSFVVNILAQALY    416
MlSQE    PLTGGGLTAVFSDIQILSAHLLAMPQFKNTDLIHEKIEAYYRDRKR-AWANLNILAWALY    351
         ****** *;.;** ;;* ;; ;*  ; ;    ;  ;;**   **  ;. *;*****;***

HsSQE    ELFSATDDSLHQLRKACFLYFKLGGECVAGPVGLLSVLSPMPLVLIGHFFAVAIYAVYFC    476
MlSQE    AVMSN-----DLLKTAVFKYLQCGGAWAQESIAVLAGLNRKHFSLIKQFFCFLAVFGACNL    406
          ;;*  .    * ;;*  *;;  **  ;     ;**;  *;;  ;;  ** ;;** ;;.;;.

HsSQE    FKSEPWITKPRALLSSGAVLYKACSVIFPLIYSEMKYMVH    516
MlSQE    LQQ-SISNIPKAL----KLLKDAFVIIKPLIKMELS----    437
          ;;  ;;***      ;;    ;;  *; *** .*;;
```

MICROBIAL PRODUCTION OF TRITERPENOIDS INCLUDING MOGROSIDES

BACKGROUND

Mogrosides are triterpene-derived specialized secondary metabolites found in the fruit of the Cucurbitaceae family plant *Siraitia grosvenorii* (a/k/a monkfruit or Luo Han Guo). Their biosynthesis in fruit involves number of consecutive glycosylations of the aglycone mogrol to the final sweet products Mogroside V (Mog. V). The food industry is increasing its use of mogroside fruit extract as a natural non-sugar food sweetener. For example, Mog. V has a sweetening capacity that is ~250 times that of sucrose (Kasai et al., *Agric Biol Chem* (1989)). Moreover, additional health benefits of mogrosides have been revealed in recent studies (Li et al., *Chin J Nat Med* (2014)).

A variety of factors are promoting a surge in interest in research and commercialization of the mogrosides and monkfruit in general, including, for example, the explosion in popularity of and demand for natural sweeteners; the difficulties in scalable sourcing of the current lead natural sweetener, rebaudioside M (RebM), from the *Stevia* plant; the superior taste performance of mogroside V relative to other natural and artificial sweetener products on the market; and the medicinal potential of the plant and fruit.

Purified Mog. V has been approved as a high-intensity sweetening agent in Japan (Jakinovich et al. *Journal or Natural Products* (1990)) and the extract has gained GRAS status in the USA as a non-nutritive sweetener and flavor enhancer (GRAS 522). Extraction of mogrosides from the fruit can yield a product of varying degrees of purity, often accompanied by undesirable aftertaste. In addition, yields of mogroside from cultivated fruit are limited due to low plant yields and particular cultivation requirements of the plant. Mogrosides are present at about 1% in the fresh fruit and about 4% in the dried fruit (Li H B, et al, 2006). Mog. V is the main component, with a content of 0.5% to 1.4% in the dried fruit. Moreover, purification difficulties limit purity for Mog. V, with commercial products from plant extracts being standardized to about 50% Mog. V. It is highly likely that a pure Mog. V product will achieve greater commercial success than the blend, since it is less likely to have off flavors, will be easier to formulate into products, and has good solubility potential. It is therefore advantageous to be able to produce sweet mogroside compounds via biotechnological processes.

SUMMARY

The present invention, in various aspects and embodiments, provides a method for making mogrol glycosides, as well as other triterpenoid compounds, using recombinant microbial processes. In other aspects, the invention provides methods for making products, including foods, beverages, and sweeteners (among others), by incorporating the mogrol glycosides produced according to the methods described herein.

In one aspect, the invention provides a method for making a triterpenoid compound. The method comprises providing a recombinant microbial host cell expressing a heterologous enzyme pathway catalyzing the conversion of isopentenyl pyrophosphate (IPP) and/or dimethylallyl pyrophosphate (DMAPP) to one or more triterpenoid compounds. The heterologous enzyme pathway comprises a farnesyl diphosphate synthase (FPPS) and a squalene synthase (SQS), which are recombinantly expressed. In various embodiments, the SQS comprises an amino acid sequence that is at least 70% identical to an amino acid sequence selected from SEQ ID NOS: 2 to 16, 166, and 167. The host cell is cultured under conditions for producing the triterpenoid.

The microbial host cell in various embodiments may be prokaryotic or eukaryotic. In some embodiments, the microbial host cell is a bacterium such as *Escherichia coli*, or the microbial cell may be a yeast cell. In some embodiments, the host cell is a bacterial or yeast host cell engineered to increase production of IPP and DMAPP from glucose.

In some embodiments, the SQS comprises an amino acid sequence that is at least 70% identical to *Artemisia annua* SQS (SEQ ID NO: 11), AaSQS has high activity in *E. coli*. Other SQS enzymes that are active in *E. coli* (including with 37° C. culture conditions) include *Siraitia grosvenorii* SQS (SEQ ID NO: 2), *Euphorbia lathyris* SQS (SEQ ID NO: 14), *Eleutherococcus senticosus* SQS (SEQ ID NO: 16), *Flavobacteriales bacterium* SQS (SEQ ID NO: 166), and *Bacteroidetes bacterium* SQS (SEQ ID NO: 167).

In various embodiments, the heterologous enzyme pathway produces squalene, which is optionally an intermediate that acts as a substrate for additional downstream pathway enzymes. In some embodiments, squalene is recovered from the culture, and may be recovered from the microbial cells, and/or may be recovered from the media and/or an organic layer.

In various embodiments, the host cell expresses one or more enzymes that produce mogrol from squalene. For example, the host cell may express one or more of squalene epoxidase (SQE), cucurbitadienol synthase (CDS), epoxide hydrolase (EPH), cytochrome P450 oxidases (CYP450), non-heme iron-dependent oxygenases, and cytochrome P450 reductases (CPR).

In some embodiments, the heterologous enzyme pathway further comprises a squalene epoxidase (SQE). For example, the heterologous enzyme pathway may comprise an SQE that produces 2,3-oxidosqualene. Exemplary squalene epoxidases may comprise an amino acid sequence that is at least 70% identical to any one of SEQ ID NOS: 17 to 39, 168, 169, and 170. For example, the squalene epoxidase may comprise an amino acid sequence that is at least 70% identical to *Methylomonas lenta* squalene epoxidase (SEQ ID NO: 39). MlSQE has high activity in *E. coli*. Further, when coexpressed with AaSQS, high titer of the single epoxylated product (2,3-oxidosqualene) was observed. Accordingly, coexpression of AaSQS (or an engineered derivative) with MsSQE (or an engineered derivative) has a good potential for bioengineering of the mogrol pathway. Alternative SQE enzymes in accordance with the disclosure include *Bathymodiolus azoricus* Endosymbiont squalene epoxidase (SEQ ID NO: 168), *Methyloprofundus sediment* squalene epoxidase (SEQ ID NO: 169), *Methylomicrobium buryatense* squalene epoxidase (SEQ ID NO: 170), and engineered derivatives thereof.

In various embodiments, the heterologous enzyme pathway further comprises a triterpene cyclase. In some embodiments, where the microbial cell coexpresses FPPS, SQS, SQE, and the triterpene cyclase, the microbial cell produces cucurbitadienol. The cucurbitadienol may be the substrate for downstream enzymes in the heterologous pathway, or is alternatively recovered from the culture (either from microbial cells, or the culture media or organic layer). In some embodiments, the triterpene cyclase comprises an amino acid sequence that is at least 70% identical to an amino acid sequence selected from SEQ ID NOS: 40 to 55. In some embodiments, the triterpene cyclase has cucurbitadienol synthase (CDS) activity. The CDS in various embodiments comprises an amino acid sequence that is at least 70% identical to the amino acid sequence of SEQ ID NO: 40 (*Siraitia grosvenorii*).

In some embodiments, the heterologous enzyme pathway further comprises an epoxide hydrolase (EPH). Exemplary EPH enzymes comprise an amino acid sequence that is at least 70% identical to amino acid sequence selected from SEQ ID NOS: 56 to 72. In some embodiments, the EPH may employ as a substrate 24,25-epoxycucurbitadienol, for production of 24,25-dihydroxycucurbitadienol.

In some embodiments, the heterologous pathway further comprises one or more oxidases. The one or more oxidases may be active on cucurbitadienol or oxygenated products thereof as a substrate, adding (collectively) hydroxylations at C11, C24 and 25, thereby producing mogrol. Exemplary oxidase enzymes are described herein.

In various embodiments, the heterologous enzyme pathway produces mogrol, which may be an intermediate for downstream enzymes in the heterologous pathway, or in some embodiments is recovered from the culture. Mogrol may be recovered from host cells in some embodiments, or in some embodiments, can be recovered from the culture media or organic layer.

In some embodiments, the heterologous enzyme pathway further comprises one or more uridine diphosphate-dependent glycosyltransferase (UGT) enzymes, thereby producing one or more mogrol glycosides (or "mogrosides"). The mogrol glycoside may be pentaglycosylated, or hexaglycosylated in some embodiments. In other embodiments, the mogrol glycoside has two, three, or four glucosylations. The one or more mogrol glycosides may be selected from Mog. II-E, Mog. III-A-2, Mog. II-E, Mog. IIIx, Mog. IV-A, Mog. IV-E, Siamenoside, Isomog. IV, and Mog. V. In some embodiments, the mogroside is a pentaglucosylated or hexaglucosylated mogroside.

In some embodiments, the host cell expresses a UGT enzyme that catalyzes the primary glycosylation of mogrol at C24 and/or C3 hydroxyl groups. In some embodiments, the UGT enzyme catalyzes beta 1,2 and/or beta 1,6 branching glycosylations of mogrol glycosides at the primary C3 and C24 glucosyl groups. Exemplary UGT enzymes are disclosed herein (SEQ ID NOS: 116 to 165). For example, in some embodiments, the microbial cell expresses at least four UGT enzymes, resulting in glucosylation of mogrol at the C3 hydroxyl group, the C24 hydroxyl group, as well as a further 1,6 glucosylation at the C3 glucosyl group, and a further 1,6 glucosylation and a further 1,2 glucosylation at the C24 glucosyl group. The product of such glucosylation reactions is Mog. V.

For example, at least one UGT enzyme expressed by the microbial cell may comprise an amino acid sequence that is at least 70% identical to *Stevia rebaudiana* UGT85C1 (SEQ ID NO: 165). UGT85C1, and derivatives thereof, provide for glucosylation of the C3 hydroxyl of mogrol or Mog. 1A.

In some embodiments, at least one UGT enzyme comprises an amino acid sequence that is at least 70% identical to *Stevia rebaudiana* UGT85C2 (SEQ ID NO: 146). UGT85C2, and derivatives thereof, provide for glucosylation of the C24 hydroxyl of mogrol or Mog. 1E.

In some embodiments, at least one UGT enzyme comprises an amino acid sequence that is at least 70% identical to *Coffea arabica* UGT (CaUGT_1,6) (SEQ ID NO: 164). CaUGT_1,6, and derivatives thereof, provide for further beta 1,6 glucosylation at C24 and C3 glycosyl groups.

In some embodiments, at least one UGT enzyme comprises an amino acid sequence that is at least 70% identical to *Siraitia grosvenorii* UGT94-289-3 (SEQ ID NO: 117). UGT94-289-3 ("Sg94_3"), and derivatives thereof, provide for further beta 1,6 glucosylation at C24 and C3 glucosyl groups, as well as beta 1,2 glucosylation at the C24 glucosyl group.

In some embodiments, the microbial cell expresses at least one UGT enzyme capable of catalyzing beta 1,2 addition of a glucose molecule to at least the C24 glucosyl group (e.g., of Mog. IVA, see FIG. 4). Exemplary UGT enzymes in accordance with these embodiments include *Siraitia grosvenorii* UGT94-289-3 (SEQ ID NO: 117), *Stevia rebaudiana* UGT91D1 (SEQ ID NO:147), *Stevia rebaudiana* UGT91D2 (SEQ ID NO: 148), *Stevia rebaudiana* UGT91D2e (SEQ ID NO: 149), OsUGT1-2 (SEQ ID NO: 150), or MbUGT1-2 (SEQ ID NO: 163), or derivatives thereof.

In some embodiments, at least one UGT enzyme is a circular permutant of a wild-type UGT enzyme, optionally having amino acid substitutions, deletions, and/or insertions with respect to the corresponding position of the wild-type enzyme. Circular permutants can provide novel and desirable substrate specificities, product profiles, and reaction kinetics over the wild-type enzymes. In some embodiments, at least one UTG enzyme is a circular permutant of SEQ ID NO: 146, SEQ ID NO: 164, or SEQ ID NO: 165, SEQ ID NO: 117, SEQ ID NO: 147, SEQ ID NO: 148, SEQ ID NO: 149, SEQ ID NO: 150, and SEQ ID NO: 163, or a derivative thereof.

Mogrol glycosides can be recovered from the microbial culture. For example, mogrol glycosides may be recovered from microbial cells, or in some embodiments, are predominately transported into the extracellular media, where they may be recovered or sequestered.

In some aspects, the invention provides a method for making a pentaglycosylated or hexaglycosylated mogroside, such as Mog V. In various embodiments, the invention comprises reacting a mogrol glycoside with a plurality of uridine diphosphate dependent glycosyltransferase (UGT) enzymes. For example, in some embodiments, one UGT enzyme comprises an amino acid sequence that is at least 70% identical to SEQ ID NO: 164 (or circular permutant thereof), where the UGT enzyme catalyzes beta 1,6 addition of a glucose. Other UGT enzymes as described herein will be coexpressed to glycosylate the desired substrate to Mog. V.

In some embodiments, the mogrol is reacted with about four UGT enzymes. A first UGT enzyme comprises an amino acid sequence that is at least 70% identical to *Stevia rebaudiana* UGT85C1 (SEQ ID NO: 165), or a circular permutant thereof. A second UGT enzyme comprises an amino acid sequence that is at least 70% identical to *Stevia rebaudiana* UGT85C2 (SEQ ID NO: 146), or a circular permutant thereof. A third UGT enzyme comprises an amino acid sequence that is at least 70% identical to *Coffea arabica* UGT (SEQ ID NO: 164), or a circular permutant thereof. A fourth UGT enzyme is capable of catalyzing beta 1,2 addition of a glucose molecule, such as SgUGT94_289_3 (SEQ ID NO:117) or a derivative or circular permutant thereof.

The mogrol glycoside can be recovered and/or purified from the reaction or culture. In some embodiments, the mogrol glycoside is Mog. V, Mog. VI, or Isomog. V.

In various embodiments, the reaction is performed in a microbial cell, and UGT enzymes are recombinantly expressed in the cell. In some embodiments, mogrol is produced in the cell by a heterologous mogrol synthesis pathway, as described herein. In other embodiments, mogrol or mogrol glycosides are fed to the cells for glycosylation.

In still other embodiments, the reaction is performed in vitro using purified UGT enzyme, partially purified UGT enzyme, or recombinant cell lysates.

In other aspects, the invention provides a method for making a product comprising a mogrol glycoside. The method comprises producing a mogrol glycoside in accordance with this disclosure, and incorporating the mogrol glycoside into a product. In some embodiments, the mogrol glycoside is Mog. V, Mog. VI, or Isomog. V. In some embodiments, the product is a sweetener composition, flavoring composition, food, beverage, chewing gum, texturant, pharmaceutical composition, tobacco product, nutraceutical composition, or oral hygiene composition.

The product may be a sweetener composition comprising a blend of artificial and/or natural sweeteners. For example, the composition may further comprise one or more of a steviol glycoside, aspartame, and neotame. Exemplary steviol glycosides comprises one or more of RebM, RebB, RebD, RebA, RebE, and RebI.

Other aspects and embodiments of the invention will be apparent from the following detailed disclosure.

DESCRIPTION OF THE FIGURES

FIG. 10 is an amino acid alignment of CaUGT_1,6 and SgUGT94_289_3 using Clustal Omega (Version CLUSTAL O (1,2,4). These sequences share 54% amino acid identity.

FIG. 11 is an amino acid alignment of *Homo sapiens* squalene synthase (HsSQS) (NCBI accession NP_004453.3) and AaSQS (SEQ ID NO: 11) using Clustal Omega (Version CLUSTAL O (1.2.4)). HsSQS has a published crystal structure (PDB entry: 1EZF). These sequences share 42% amino acid identity.

FIG. 12 is an amino acid alignment of *Homo sapiens* squalene epoxidase (HsSQE) (NCBI accession XP_011515548) and MlSQE (SEQ ID NO: 39) using Clustal Omega (Version CLUSTAL O (1.2.4)). HsSQE has a published crystal structure (PDB entry: 6C6N). These sequences share 35% amino acid identity.

DETAILED DESCRIPTION OF THE INVENTION

The present invention, in various aspects and embodiments, provides a method for making mogrol glycosides, as well as other triterpenoid compounds, using recombinant microbial processes. In other aspects, the invention provides methods for making products, including foods, beverages, and sweeteners (among others), by incorporating the mogrol glycosides produced according to the methods described herein.

As used herein, the terms "terpene or triterpene" are used interchangeably with the terms "terpenoid" or "triterpenoid," respectively.

In one aspect, the invention provides a method for making a triterpenoid compound. The method comprises providing a recombinant microbial host cell expressing a heterologous enzyme pathway catalyzing the conversion of isopentenyl pyrophosphate (IPP) and/or dimethylallyl pyrophosphate (DMAPP) to one or more triterpenoid compounds. The heterologous enzyme pathway comprises a farnesyl diphosphate synthase (FPPS) and a squalene synthase (SQS), which are recombinantly expressed. In various embodiments, the SQS comprises an amino acid sequence that is at least 70% identical to an amino acid sequence selected from SEQ ID NOS: 2 to 16, 166, and 167. The host cell is cultured under conditions for producing the triterpenoid.

By way of non-limiting example, the FPPS may be *Saccharomyces cerevisiae* farnesyl pyrophosphate synthase (ScFPPS) (SEQ ID NO: 1), or modified variants thereof. Modified variants may comprise an amino acid sequence that is at least 70% identical to SEQ ID NO: 1). For example, the FPPS may comprise an amino acid sequence that is at least 80%, or at least 85%, or at least 90%, or at least 95%, or at least 98%, or at least 99% identical to SEQ ID NO: 1. In some embodiments, the FPPS comprises an amino acid sequence having from 1 to 20 amino acid modifications or having from 1 to 10 amino acid modifications with respect to SEQ ID NO: 1, the amino acid modifications being independently selected from amino acid substitutions, deletions, and insertions. Numerous other FPPS enzymes are known in the art, and may be employed for conversion of IPP and/or DMAPP to farnesyl diphosphate in accordance with this aspect.

Figure 5:
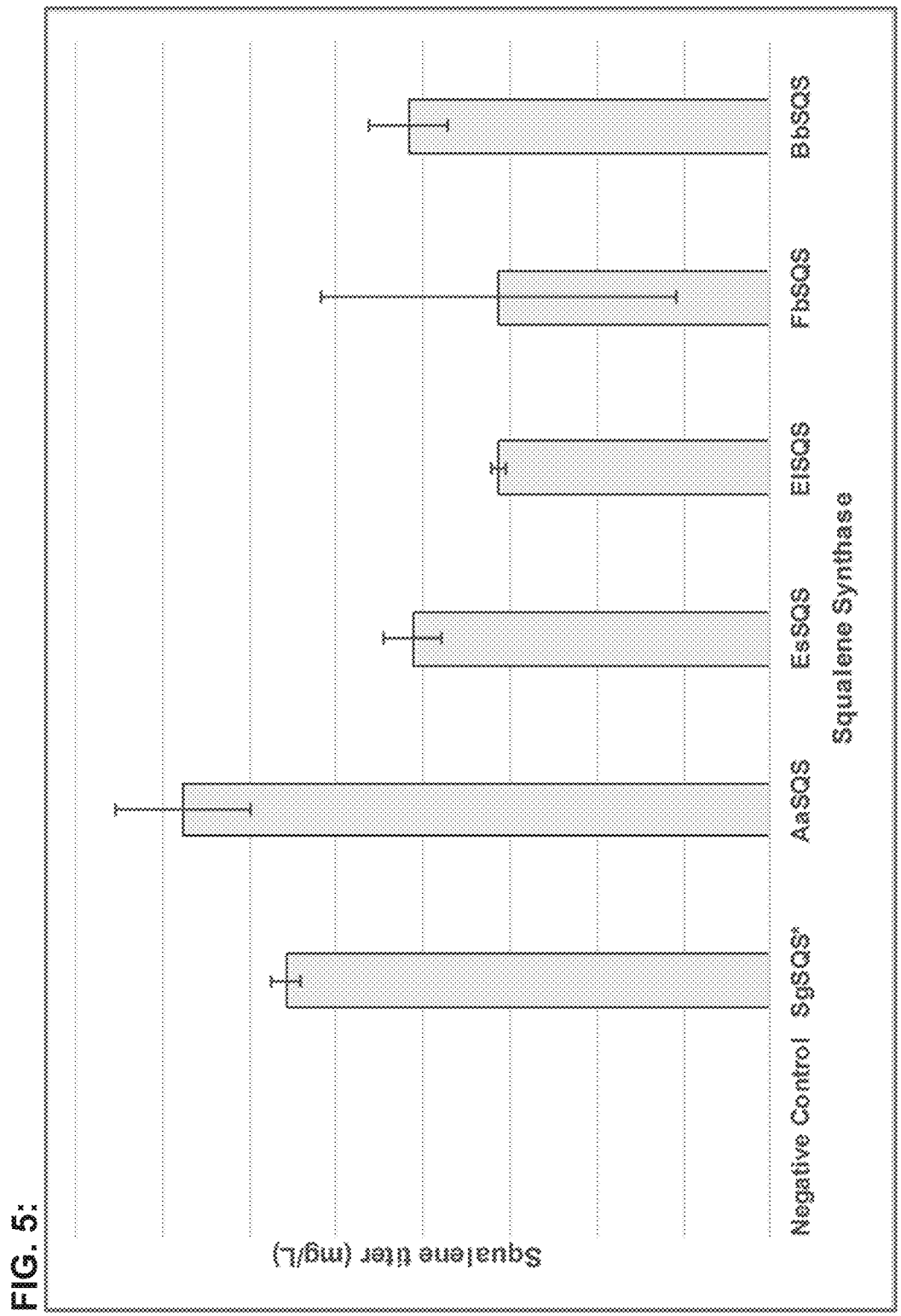
FIG. 5 shows results for in vivo production of squalene in E. coli using different squalene synthases. The asterisk denotes a different plasmid construct and experiment run on a different day from the others shown. Abbreviations: SQS, squalene synthase; Sg, *Siratia grosvenorii*; Aa, *Artemesia annua*; Es, *Eleutherococcus senticosus*; El, *Euphorbia lathyris*; Fb, *Flavobacteriales bacterium*; Bb, *Bacteroidetes bacterium*.

In some embodiments, the SQS comprises an amino acid sequence that is at least 70% identical to *Artemisia annua* SQS (SEQ ID NO: 11). For example, the SQS may comprise an amino acid sequence that is at least 80%, or at least 85%, or at least 90%, or at least 95%, or at least 98%, or at least 99% identical to SEQ ID NO: 11. In some embodiments, the SQS comprises an amino acid sequence having from 1 to 20 amino acid modifications or from 1 to 10 amino acid modifications with respect to SEQ ID NO: 11, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, AaSQS has high activity in *E. coli*.

In some embodiments, the SQS comprises an amino acid sequence that is at least 70% identical to *Siraitia grosvenorii* SQS (SEQ ID NO: 2). For example, the SQS may comprise an amino acid sequence that is at least 80%, or at least 85%, or at least 90%, or at least 95%, or at least 98%, or at least 99% identical to SEQ ID NO: 2. In some embodiments, the SQS comprises an amino acid sequence having from 1 to 20 amino acid modifications or from 1 to 10 amino acid modifications with respect to SEQ ID NO: 2, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, SgSQS has high activity in *E. coli*.

In some embodiments, the SQS comprises an amino acid sequence that is at least 70% identical to *Euphorbia lathyris* SQS (SEQ ID NO: 14). For example, the SQS may comprise an amino acid sequence that is at least 80%, or at least 85%, or at least 90%, or at least 95%, or at least 98%, or at least 99% identical to SEQ ID NO: 14. In some embodiments, the SQS comprises an amino acid sequence having from 1 to 20 amino acid modifications or from 1 to 10 amino acid modifications with respect to SEQ ID NO: 14, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, ElSQS was active in *E. coli*.

In some embodiments, the SQS comprises an amino acid sequence that is at least 70% identical to *Eleutherococcus senticosus* SQS (SEQ ID NO: 16). For example, the SQS may comprise an amino acid sequence that is at least 80%, or at least 85%, or at least 90%, or at least 95%, or at least 98%, or at least 99% identical to SEQ ID NO: 16. In some embodiments, the SQS comprises an amino acid sequence having from 1 to 20 amino acid modifications or from 1 to 10 amino acid modifications with respect to SEQ ID NO: 16, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, EsSQS was active in *E. coli*.

In some embodiments, the SQS comprises an amino acid sequence that is at least 70% identical to *Flavobacteriales bacterium* SQS (SEQ ID NO: 166). For example, the SQS may comprise an amino acid sequence that is at least 80%, or at least 85%, or at least 90%, or at least 95%, or at least 98%, or at least 99% identical to SEQ ID NO: 166. In some embodiments, the SQS comprises an amino acid sequence having from 1 to 20 amino acid modifications or from 1 to 10 amino acid modifications with respect to SEQ ID NO: 166, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, FbSQS was active in *E. coli*.

In some embodiments, the SQS comprises an amino acid sequence that is at least 70% identical to *Bacteroidetes bacterium* SQS (SEQ ID NO: 167). For example, the SQS may comprise an amino acid sequence that is at least 80%, or at least 85%, or at least 90%, or at least 95%, or at least 98%, or at least 99% identical to SEQ ID NO: 167. In some embodiments, the SQS comprises an amino acid sequence having from 1 to 20 amino acid modifications or from 1 to 10 amino acid modifications with respect to SEQ ID NO: 167, the amino acid modifications being independently selected from amino acid substitutions, deletions, and insertions. Amino acid modifications may be made to increase expression or stability of the enzyme in the microbial cell, or to increase productivity of the enzyme. As shown in FIG. 5, BbSQS was active in *E. coli*.

Amino acid modifications to the SQS enzyme can be guided by available enzyme structures and homology models, including those described in Aminfar and Tohidfar, *In silico analysis of squalene synthase in Fabaceae family using bioinformatics tools*, J. Genetic Engineer. and Biotech. 16 (2018) 739-747. The publicly available crystal structure for HsSQE (PDB entry: 6C6N) may be used to inform amino acid modifications. An alignment between AaSQS and HsSQS is shown in FIG. 11. The enzymes have 42% amino acid identity.

In various embodiments, the heterologous enzyme pathway produces squalene, which is optionally an intermediate that acts as a substrate for additional downstream pathway enzymes. In some embodiments, squalene is recovered from the culture, and may be recovered from the microbial cells, and/or may be recovered from the media and/or an organic layer.

The microbial host cell in various embodiments may be prokaryotic or eukaryotic. In some embodiments, the microbial host cell is a bacteria selected from *Escherichia* spp., *Bacillus* spp., *Corynebacterium* spp., *Rhodobacter* spp., *Zymomonas* spp., *Vibrio* spp., and *Pseudomonas* spp. For example, in some embodiments, the bacterial host cell is a species selected from *Escherichia coli, Bacillus subtilis, Corynebacterium glutamicum, Rhodobacter capsulatus, Rhodobacter sphaeroides, Zymomonas mobilis, Vibrio natriegens,* or *Pseudomonas putida*. In some embodiments, the bacterial host cell is *E. coli*. Alternatively, the microbial cell may be a yeast cell, such as but not limited to a species of *Saccharomyces, Pichia,* or *Yarrowia*, including *Saccharomyces cerevisiae, Pichia pastoris,* and *Yarrowia lipolytica*.

The microbial cell will produce MEP or MVA products, which act as substrates for the heterologous enzyme pathway. The MEP (2-C-methyl-D-erythritol 4-phosphate) pathway, also called the MEP/DOXP (2-C-methyl-D-erythritol 4-phosphate/l-deoxy-D-xylulose 5-phosphate) pathway or the non-mevalonate pathway or the mevalonic acid-independent pathway refers to the pathway that converts glyceraldehyde-3-phosphate and pyruvate to IPP and DMAPP. The pathway, which is present in bacteria, typically involves action of the following enzymes: 1-deoxy-D-xylulose-5-phosphate synthase (Dxs), 1-deoxy-D-xylulose-5-phosphate reductoisomerase (IspC), 4-diphosphocytidyl-2-C-methyl-D-erythritol synthase (IspD), 4-diphosphocytidyl-2-C-methyl-D-erythritol kinase (IspE), 2C-methyl-D-erythritol 2,4-cyclodiphosphate synthase (IspF), 1-hydroxy-2-methyl-2-(E)-butenyl 4-diphosphate synthase (IspG), and isopentenyl diphosphate isomerase (IspH). The MEP pathway, and the genes and enzymes that make up the MEP pathway, are described in U.S. Pat. No. 8,512,988, which is hereby incorporated by reference in its entirety. For example, genes that make up the MEP pathway include dxs, ispC, ispD, ispE, ispF, ispG, ispH, idi, and ispA. In some embodiments, the host cell expresses or overexpresses one or more of dxs, ispC, ispD, ispE, ispF, ispG, ispH, idi, ispA, or modified variants thereof, which results in the increased production of IPP and DMAPP. In some embodiments, the triterpenoid squalene, mogrol, or other intermediate described herein) is produced at least in part by metabolic flux through an MEP pathway, and wherein the host cell has at least one additional gene copy of one or more of dxs, ispC, ispD, ispE, ispF, ispG, ispH, idi, ispA, or modified variants thereof.

The MVA pathway refers to the biosynthetic pathway that converts acetyl-CoA to IPP. The mevalonate pathway, which will be present in yeast, typically comprises enzymes that catalyze the following steps: (a) condensing two molecules of acetyl-CoA to acetoacetyl-CoA (e.g., by action of acetoacetyl-CoA thiolase); (b) condensing acetoacetyl-CoA with acetyl-CoA to form hydroxymethylglutaryl-CoenzymeA (HMG-CoA) (e.g., by action of HMG-CoA synthase (HMGS)); (c) converting HMG-CoA to mevalonate (e.g., by action of HMG-CoA reductase (HMGR)); (d) phosphorylating mevalonate to mevalonate 5-phosphate (e.g., by action of mevalonate kinase (MK)); (e) converting mevalonate 5-phosphate to mevalonate 5-pyrophosphate (e.g., by action of phosphomevalonate kinase (PMK)); and (f) converting mevalonate 5-pyrophosphate to isopentenyl pyrophosphate (e.g., by action of mevalonate pyrophosphate decarboxylase (MPD)). The MVA pathway, and the genes and enzymes that make up the MVA pathway, are described in U.S. Pat. No. 7,667,017, which is hereby incorporated by reference in its entirety. In some embodiments, the host cell expresses or overexpresses one or more of acetoacetyl-CoA thiolase, HMGS, HMGR, MK, PMK, and MPD or modified variants thereof, which results in the increased production of IPP and DMAPP. In some embodiments, the triterpenoid (e.g., mogrol or squalene) is produced at least in part by metabolic flux through an MVA pathway, and wherein the host cell has at least one additional gene copy of one or more of acetoacetyl-CoA thiolase, HMGS, HMGR, MK, PMK, MPD, or modified variants thereof.

In some embodiments, the host cell is a bacterial host cell engineered to increase production of IPP and DMAPP from glucose as described in US 2018/0245103 and US 2018/0216137, the contents of which are hereby incorporated by reference in their entireties. For example, in some embodiments the host cell overexpresses MEP pathway enzymes, with balanced expression to push/pull carbon flux to IPP and DMAP. In some embodiments, the host cell is engineered to increase the availability or activity of Fe—S cluster proteins, so as to support higher activity of IspG and IspH, which are Fe—S enzymes. In some embodiments, the host cell is engineered to overexpress IspG and IspH, so as to provide increased carbon flux to 1-hydroxy-2-methyl-2-(E)-butenyl 4-diphosphate (HMBPP) intermediate, but with balanced expression to prevent accumulation of HMBPP at an amount that reduces cell growth or viability, or at an amount that inhibits MEP pathway flux and/or terpenoid production. In some embodiments, the host cell exhibits higher activity of IspH relative to IspG. In some embodiments, the host cell is engineered to downregulate the ubiquinone biosynthesis pathway, e.g., by reducing the expression or activity of IspB, which uses IPP and FPP substrate.

Figure 2:
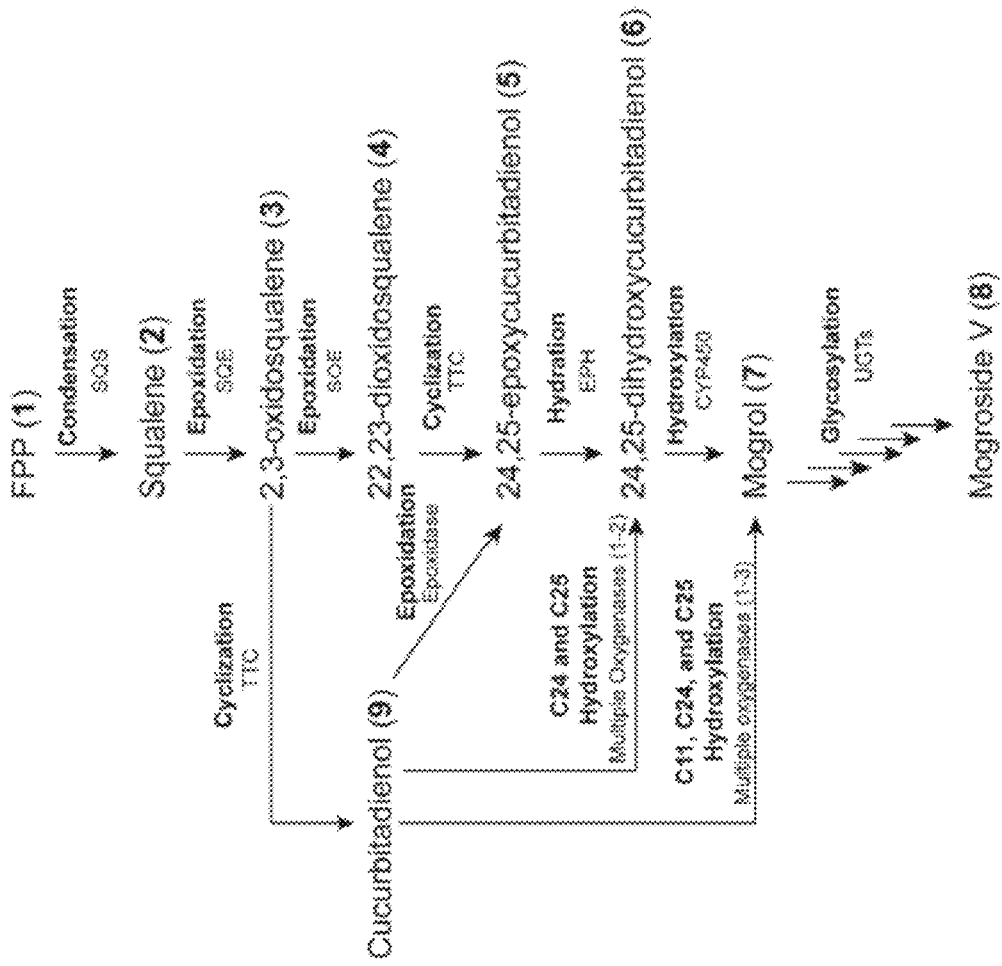
FIG. 2 shows routes to mogroside V production in vivo. The enzymatic transformation required for each step is indicated, along with the type of enzyme required. Numbers in parentheses correspond to the chemical structures in FIG. 3. Abbreviations: FPP, farnesyl pyrophosphate; SQS, squalene synthase; SQE, squalene epoxidase; TTC, triterpene cyclase; EPH, epoxide hydrolase; CYP450, cytochrome P450 with reductase partner; UGTs, uridine diphosphate glycosyltransferases.

In some embodiments, the host cell expresses one or more enzymes that produce mogrol from squalene. For example, the host cell may express one or more of squalene epoxidase (SQE), cucurbitadienol synthase (CDS), epoxide hydrolase (EPH), cytochrome P450 oxidases (CYP450), non-heme iron-dependent oxygenases, and cytochrome P450 reductases (CPR). As shown in FIG. 2, the heterologous pathway can proceed through several routes to mogrol, which may involve one or two epoxidations of the core substrate. In some embodiments, the pathway proceeds through cucurbitadienol, and in some embodiments, does not involve a further epoxidation step. In some embodiments, one or more of SQE, CDS, EPH, CYP450, non-heme iron-dependent oxygenases, flavodoxin reductases (FPR), ferredoxin reductases (FDXR), and CPR enzymes are engineered to increase flux to mogrol.

In some embodiments, the heterologous enzyme pathway further comprises a squalene epoxidase (SQE). For example, the heterologous enzyme pathway may comprise an SQE, that produces 2,3-oxidosqualene (intermediate (3) in FIG. 2). In some embodiments, the SQE will produce 22,23-dioxidosqualene (intermediate (4) in FIG. 2). For example, the squalene epoxidase may comprise an amino acid sequence that is at least 70% identical to any one of SEQ ID NOS: 17 to 39, 168-170.

Figure 6:
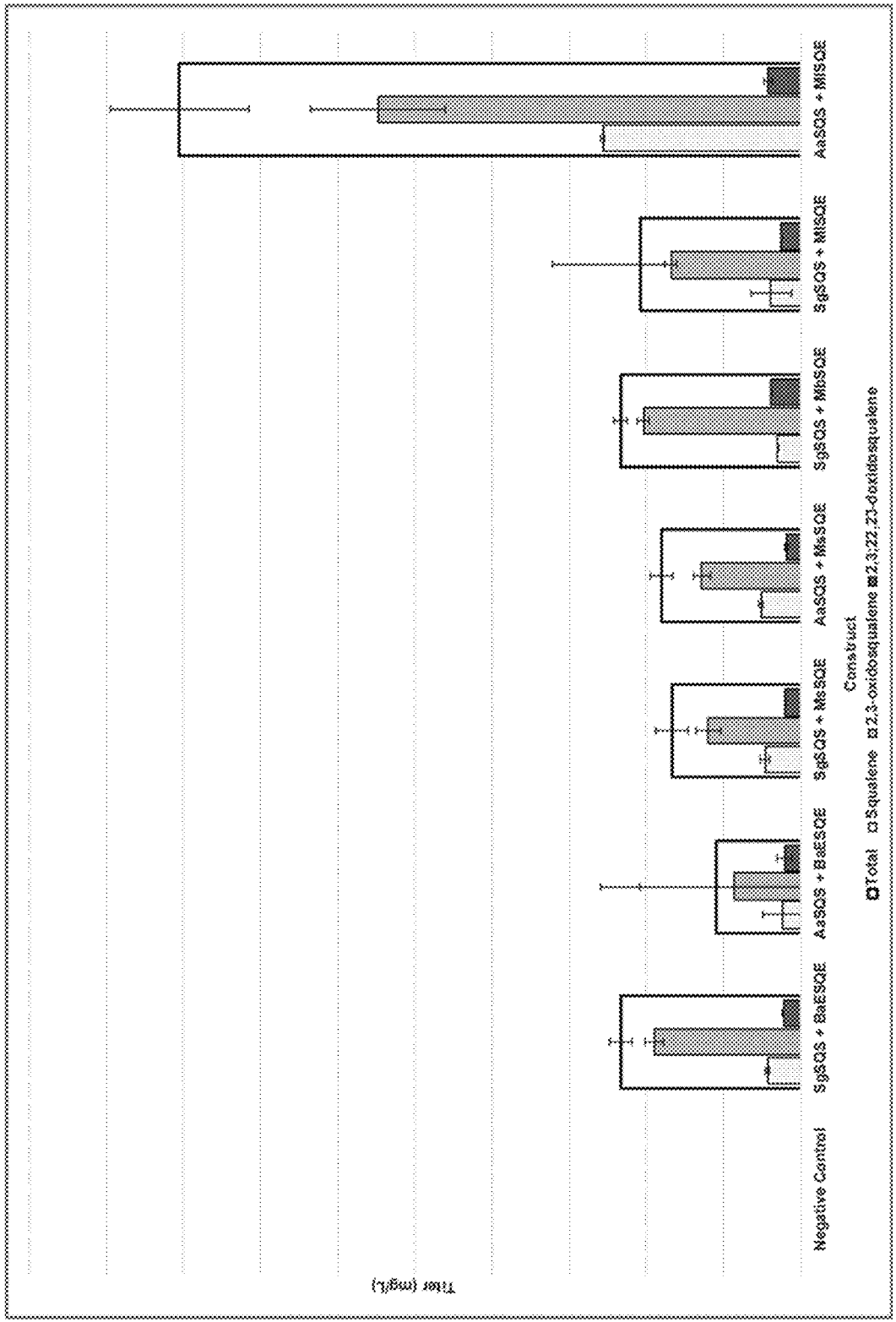
FIG. 6 shows results for in vivo production of squalene, 2,3-oxidosqualene, and 2,3;22,23-dioxidosqualene using different squalene epoxidases. Abbreviations: SQS, squalene synthase; SQE, squalene epoxidase; Sg, *Siratia grosvenorii*; Aa, *Artemesia annua*; BaE, *Bathymodiolus azoricus* endosymbiont; Ms, *Methyloprofundus sedimenti*; Mb, *Methylomicrobium buryatense*; Ml, *Methylomonas lenta*.

In some embodiments, the squalene epoxidase comprises an amino acid sequence that is at least 70% identical to *Methylomonas lento* squalene epoxidase (SEQ ID NO: 39). For example, the SQE may comprise an amino acid sequence that is at least 80%, or at least 85%, or at least 90%, or at least 95%, or at least 98%, or at least 99% identical to SEQ ID NO: 39. In various embodiments, the SQE comprises an amino acid sequence having from 1 to 20 amino acid modifications or from 1 to 10 amino acid modifications with respect to SEQ ID NO: 39, the amino acid modifications being independently selected from amino acid substitutions, deletions, and insertions. As shown in FIG. 6, MlSQE had good activity in *E. coli*. Further, when coexpressed with AaSQS, high levels of the single epoxylated product (2,3-oxidosqualene was observed. Accordingly, coexpression of AaSQS (or an engineered derivative) with MlSQE (or an engineered derivative) has a good potential for bioengineering of the mogrol pathway. Amino acid modifications may be made to increase expression or stability of the SQE enzyme in the microbial cell, or to increase productivity of the enzyme In some embodiments, the squalene epoxidase comprises an amino acid sequence that is at least 70% identical to *Bathymodiolus azoricus* Endosymbiont squalene epoxidase (SEQ ID NO: 168). For example, the SQE may comprise an amino acid sequence that is at least 80%, or at least 85%, or at least 90%, or at least 95%, or at least 98%, or at least 99% identical to SEQ ID NO: 168. In various embodiments, the SQE comprises an amino acid sequence having from 1 to 20 amino acid modifications or from 1 to 10 amino acid modifications with respect to SEQ ID NO: 168, the amino acid modifications being independently selected from amino acid substitutions, deletions, and insertions. As shown in FIG. 6, BaESQE had good activity in *E. coli*. Amino acid modifications may be made to increase expression or stability of the enzyme in the microbial cell, or to increase productivity of the enzyme.

In some embodiments, the squalene epoxidase comprises an amino acid sequence that is at least 70% identical to *Methyloprofundus sediment* squalene epoxidase (SEQ ID NO: 169). For example, the SQE may comprise an amino acid sequence that is at least 80%, or at least 85%, or at least 90%, or at least 95%, or at least 98%, or at least 99% identical to SEQ ID NO: 169. In various embodiments, the SQE comprises an amino acid sequence having from 1 to 20 amino acid modifications or from 1 to 10 amino acid modifications with respect to SEQ ID NO: 169, the amino acid modifications being independently selected from amino acid substitutions, deletions, and insertions. As shown in FIG. 6, MsSQE had good activity in *E. coli*. Amino acid modifications may be made to increase expression or stability of the enzyme in the microbial cell, or to increase productivity of the enzyme.

In some embodiments, the squalene epoxidase comprises an amino acid sequence that is at least 70% identical to *Methylomicrobium buryatense* squalene epoxidase (SEQ ID NO: 170). For example, the SQE may comprise an amino acid sequence that is at least 80%, or at least 85%, or at least 90%, or at least 95%, or at least 98%, or at least 99% identical to SEQ ID NO: 170. In various embodiments, the SQE comprises an amino acid sequence having from 1 to 20 amino acid modifications or from 1 to 10 amino acid modifications with respect to SEQ ID NO: 170, the amino acid modifications being independently selected from amino acid substitutions, deletions, and insertions. As shown in FIG. 6, MbSQE had good activity in *E. coli*. Amino acid modifications may be made to increase expression or stability of the enzyme in the microbial cell, or to increase productivity of the enzyme.

Other SEQ enzymes tested showed no activity in *E. coli*.

Amino acid modifications can be guided by available enzyme structures and homology models, including those described in Padyana A K, et al., *Structure and inhibition mechanism of the catalytic domain of human squalene epoxidase, Nat. Comm.* (2019) Vol. 10(97): 1-10; or Ruckenstulh et al., *Structure-Function Correlations of Two Highly Conserved Motifs in Saccharomyces cerevisiae Squalene Epoxidase, Antimicrob. Agents and Chemo.* (2008) Vol. 52(4): 1496-1499. FIG. 12 shows an alignment of HsSQE and MISEQ, which is useful for guiding engineering of the enzymes for expression, stability, and productivity in microbial host cells. The two enzymes have 35% identity.

In various embodiments, the heterologous enzyme pathway further comprises a triterpene cyclase. In some embodiments, where the microbial cell coexpresses FPPS, SQS, SQE, and the triterpene cyclase, the microbial cell produces cucurbitadienol (compound (9) in FIG. 2). The cucurbitadienol may be the substrate for downstream enzymes in the heterologous pathway, or is alternatively recovered from the culture (either from microbial cells, or the culture media or organic layer).

In some embodiments, the triterpene cyclase comprises an amino acid sequence that is at least 70% identical to an amino acid sequence selected from SEQ ID NOS: 40 to 55. In some embodiments, the triterpene cyclase has cucurbitadienol synthase (CDS) activity. The CDS in various embodiments comprises an amino acid sequence that is at least 70% identical to the amino acid sequence of SEQ ID NO: 40, and may comprise an amino acid sequence that is at least 80%, or at least 85%, or at least 90%, or at least 95%, or at least 98%, or at least 99% identical to SEQ ID NO: 40. For example, the CDS may comprise an amino acid sequence having from 1 to 20 amino acid modifications or having from 1 to 10 amino acid modifications with respect to SEQ ID NO: 40, the amino acid modifications being independently selected from amino acid substitutions, deletions, and insertions. Amino acid modifications may be made to increase expression or stability of the enzyme in the microbial cell, or to increase productivity of the enzyme.

Amino acid modifications can be guided by available enzyme structures and homology models, including those described in Itkin M., et al., *The biosynthetic pathway of the nonsugar, high-intensity sweetener mogroside V from Siraitia grosvenorii, PNAS* (2016) Vol 113(47): E7619-E7628. For example, the CDS may be modeled using the structure of human lanosterol synthase (oxidosqualene cyclase) (PDB IW6K).

In some embodiments, the heterologous enzyme pathway further comprises an epoxide hydrolase (EPH). The EPH may comprise an amino acid sequence that is at least 70% identical to amino acid sequence selected from SEQ ID NOS: 56 to 72. In some embodiments, the EPH may employ as a substrate 24,25-epoxy cucurbitadienol (intermediate (5) of FIG. 2), for production of 24,25-dihydroxycucurbitadienol (intermediate (6) of FIG. 2). In some embodiments, the EPH comprises an amino acid sequence that is at least 80%, or at least 85%, or at least 90%, or at least 95%, or at least 98%, or at least 99% identical to one of SEQ ID NOS: 56 to 72. Amino acid modifications may be made to increase expression or stability of the enzyme in the microbial cell, or to increase productivity of the enzyme.

In some embodiments, the heterologous pathway further comprises one or more oxidases. The one or more oxidases may be active on cucurbitadienol or oxygenated products thereof as a substrate, adding (collectively) hydroxylations at C11, C24 and 25, thereby producing mogrol (see FIG. 2).

In some embodiments, at least one oxidase is a cytochrome P450 enzyme. Exemplary cytochrome P450 enzymes comprise an amino acid sequence that is at least 70% identical to an amino acid sequence selected from SEQ ID NOS: 73 to 91. In some embodiments, at least one P450 enzyme comprises an amino acid sequence that is at least 80%, or at least 85%, or at least 90%, or at least 95%, or at least 98%, or at least 99% identical to one of SEQ ID NOS: 73 to 91.

In some embodiments, particularly in embodiments in which the microbial cell is a bacterium, the CYP450 and/or CPR is modified as described in US 2018/0251738, the contents of which are hereby incorporated by reference in their entireties. For example, in some embodiments, the CYP450 enzyme has a deletion of all or part of the wild type P450 N-terminal transmembrane region, and the addition of a transmembrane domain derived from an *E. coli* or bacterial inner membrane, cytoplasmic C-terminus protein. In some embodiments, the transmembrane domain is a single-pass transmembrane domain. In some embodiments, the transmembrane domain is a multi-pass (e.g., 2, 3, or more transmembrane helices) transmembrane domain.

In some embodiments, at least one oxidase is a non-heme iron oxidase. Exemplary non-heme iron oxidases comprise an amino acid sequence that is at least 70% identical to an amino acid sequence selected from SEQ ID NOS: 100 to 115. In some embodiments, the non-home iron oxidase comprises an amino acid sequence that is at least 80%, or at least 85%, or at least 90%, or at least 95%, or at least 98%, or at least 99% identical to one of SEQ ID NOS: 100 to 115.

In various embodiments, the microbial host cell expresses one or more electron transfer proteins selected from a cytochrome P450 reductase (CPR), flavodoxin reductase (FPR) and ferredoxin reductase (FDXR) sufficient to regenerate the one or more oxidases. Exemplary CPR proteins are provided herein as SEQ ID NOS: 92 to 99.

In various embodiments, the heterologous enzyme pathway produces mogrol, which may be an intermediate for downstream enzymes in the heterologous pathway, or in some embodiments is recovered from the culture. Mogrol may be recovered from host cells in some embodiments, or in some embodiments, can be recovered from the culture media or organic layer.

In some embodiments, the heterologous enzyme pathway further comprises one or more uridine diphosphate-dependent glycosyltransferase (UGT) enzymes, thereby producing one or more mogrol glycosides (or "mogrosides"). The mogrol glycoside may be pentaglycosylated, or hexaglycosylated in some embodiments. In other embodiments, the mogrol glycoside has two, three, or four glucosylations. The one or more mogrol glycosides may be selected from Mog. II-E, Mog. III-A-2, Mog. III-E, Mog. IIIx, Mog. IV-A, Mog. IV-E, Siamenoside, Isomog. IV, and Mog. V. In some embodiments, the mogroside is a pentaglucosylated or hexaglucosylated mogroside. In some embodiments, the one or more mogrol glycosides include Mog. VI. Isomog. V, and Mog. V. In some embodiments, the host cell produces Mog. V.

In some embodiments, the host cell expresses a UGT enzyme that catalyzes the primary glycosylation of mogrol at C24 and/or C3 hydroxyl groups. In some embodiments, the UGT enzyme catalyzes beta 1,2 and/or beta 1,6 branching glycosylations of mogrol glycosides at the primary C3 and C24 glucosyl groups. In some embodiments, the UGT enzyme catalyzes beta 1,2 glucosylation of Mog IV-A, beta 1,6 glucosylation of Mog. IV, and/or beta 1,6 glucosylation of Siamenoside to Mog. V. In some embodiments, the UGT enzyme catalyzes the beta 1,6 glucosylation of Mog. V to Mog. VI. In some embodiments, the UGT enzyme catalyzes the beta 1,4 glucosylation of Siamenoside and/or the beta 1,6 glucosylation of Isomog. IV to Isomog. V.

Figure 4:
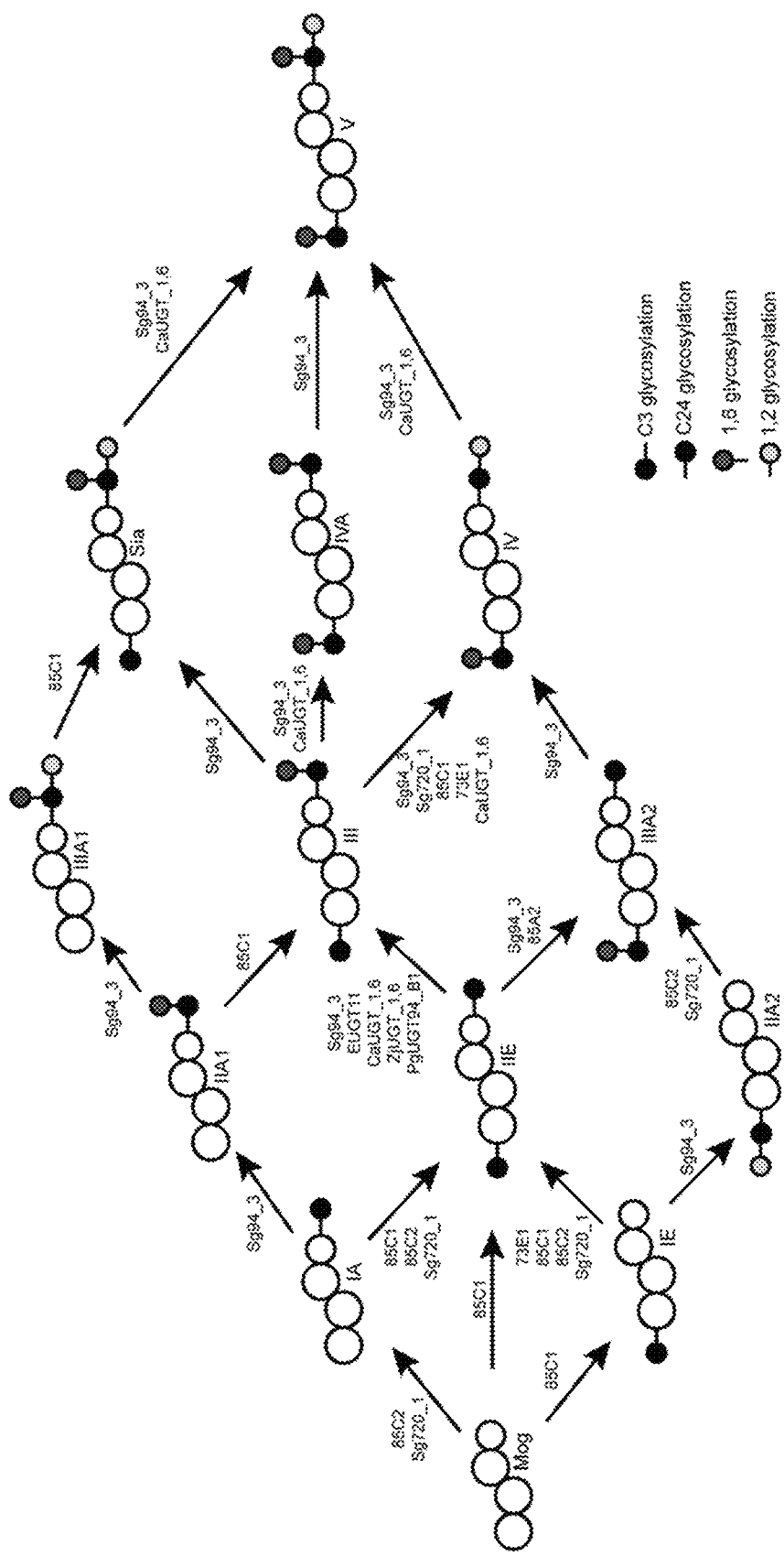
FIG. 4 illustrates glycosylation routes to mogroside V, and in vitro bio-transformation activity observed for various UGT enzymes. Bubble structures represent different mogrosides. White tetra-cyclic core represents mogrol. The numbers below each structure indicate the particular glycosylated mogroside, while the notation with the arrows indicates the enzymes observed to exhibit the glycosylation activity. Black circles represent C3 or C24 glucosylations. Dark grey vertical circles represent 1,6-glucosylations. Light grey horizontal circles represent 1,2-glucosylations. Abbreviations: Mog, mogrol; sia, siamenoside.

In some embodiments, at least one UGT enzyme comprises an amino acid sequence that is at least 70% identical to an amino acid sequence selected from SEQ ID NOS: 116 to 165. For example, in some embodiments, the UGT enzyme comprises an amino acid sequence that is at least 80%, or at least 85%, or at least 90%, or at least 95%, or at least 98%, or at least 99% identical to one of SEQ ID NOS: 116 to 165. For example, in some embodiments, the microbial cell expresses at least four UGT enzymes, resulting in glucosylation of mogrol at the C3 hydroxyl group, the C24 hydroxyl group, as well as a further 1,6 glucosylation at the C3 glucosyl group, and a further 1,6 glucosylation and a further 1,2 glucosylation at the C24 glucosyl group. The product of such glucosylation reactions is Mog. V (FIG. 4).

For example, at least one UGT enzyme expressed by the microbial cell may comprise an amino acid sequence that is at least 70% identical to *Stevia rebaudiana* UGT85C1 (SEQ ID NO: 165). UGT85C1, and derivatives thereof, provide for glucosylation of the C3 hydroxyl of mogrol or Mog. 1A. Other glucosyltransferase reactions detected for UGT85C1 are shown in FIG. 4. In some embodiments, at least one UGT enzyme may comprise an amino acid sequence that is at least 80%, or at least 85%, or at least 90%, or at least 95%, or at least 98%, or at least 99% identical to SEQ ID NO: 165. In some embodiments, the UGT enzyme comprises an amino acid sequence having from 1 to 20 or having from 1 to 10 amino acid modifications with respect to SEQ ID NO: 165, the amino acid modifications being independently selected from amino acid substitutions, deletions, and insertions. Amino acid modifications may be made to increase expression or stability of the enzyme in the microbial cell, or to increase productivity of the enzyme for particular substrates.

In some embodiments, at least one UGT enzyme comprises an amino acid sequence that is at least 70% identical to *Stevia rebaudiana* UGT85C2 (SEQ ID NO: 146). UGT85C2, and derivatives thereof, provide for glucosylation of the C24 hydroxyl of mogrol or Mog. 1E. Other glucosyltransferase reactions detected for UGT85C2 are shown in FIG. 4. In some embodiments, at least one UGT enzyme comprises an amino acid sequence that is at least 80%, or at least 85%, or at least 90%, or at least 95%, or at least 98%, or at least 99% identical to SEQ ID NO: 146. In some embodiments, at least one UGT enzyme comprises an amino acid sequence having from 1 to 20 or from 1 to 10 amino acid modifications with respect to SEQ ID NO: 146, the amino acid modifications being independently selected from amino acid substitutions, deletions, and insertions. Amino acid modifications may be made to increase expression or stability of the enzyme in the microbial cell, or to increase productivity of the enzyme for particular substrates.

In some embodiments, at least one UGT enzyme comprises an amino acid sequence that is at least 70% identical to *Coffea arabica* UGT (CaUGT_1,6) (SEQ ID NO: 164). CaUGT_1,6, and derivatives thereof, provide for further beta 1,6 glucosylation at C24 and C3 glycosyl groups. Glycosyltransferase reactions observed for CaUGT_1,6 are shown in FIG. 4. In some embodiments, at least one UGT enzyme comprises an amino acid sequence that is at least 80%, or at least 85%, or at least 90%, or at least 95%, or at least 98%, or at least 99% identical to SEQ ID NO: 164. In some embodiments, at least one UGT enzyme comprises an amino acid sequence having from 1 to 20 or having from 1 to 10 amino acid modifications with respect to SEQ ID NO: 164, the amino acid modifications being independently selected from amino acid substitutions, deletions, and insertions. Amino acid modifications may be made to increase expression or stability of the enzyme in the microbial cell, or to increase productivity of the enzyme for particular substrates.

In some embodiments, at least one UGT enzyme comprises an amino acid sequence that is at least 70% identical to *Siraitia grosvenorii* UGT94-289-3 (SEQ ID NO: 117). UGT94-289-3 ("Sg94_3"), and derivatives thereof, provide for further beta 1,6 glucosylation at C24 and C3 glucosyl groups, as well as beta 1,2 glucosylation at the C24 glucosyl group. Glycosyltransferase reactions observed for Sg94_3 are shown in FIG. 4. In some embodiments, at least one UGT enzyme comprises an amino acid sequence that is at least 80%, or at least 85%, or at least 90%, or at least 95%, or at least 98%, or at least 99% identical to SEQ ID NO: 117. In some embodiments, at least one UGT enzyme comprises an amino acid sequence having from 1 to 20 amino acid modifications with respect to SEQ ID NO: 117, the amino acid modifications being independently selected from amino acid substitutions, deletions, and insertions.

In some embodiments, the microbial cell expresses at least one UGT enzyme capable of catalyzing beta 1,2 addition of a glucose molecule to at least the C24 glucosyl group (e.g., of Mog. IVA, see FIG. 4). Exemplary UGT enzymes in accordance with these embodiments include *Siraitia grosvenorii* UGT94-289-3 (SEQ ID NO: 117), *Stevia rebaudiana* UGT91D1 (SEQ ID NO:147) *Stevia rebaudiana* UGT91D2 (SEQ ID NO: 148), *Stevia rebaudiana* UGT91D2e (SEQ ID NO: 149), OsUGT1-2 (SEQ ID NO: 150), or MbUGT1-2 (SEQ ID NO: 163), or derivatives thereof. Derivatives include enzymes comprising amino acid sequence that are least 70% identical to one or more of SEQ ID NO: 117, SEQ ID NO: 147, SEQ ID NO: 148, SEQ ID NO: 149, SEQ ID NO: 150, and SEQ ID NO: 163. In some embodiments, the UGT enzyme catalyzing beta 1,2 addition of a glucose molecule to at least the C24 glucosyl group comprises an amino acid sequence that is at least 80%, or at least 85%, or at least 90%, or at least 95%, or at least 98%, or at least 99% identical to one or more of SEQ ID NO: 117, SEQ ID NO: 147, SEQ ID NO: 148, SEQ ID NO: 149, SEQ ID NO: 150, and SEQ ID NO: 163. In some embodiments, at least one UGT enzyme comprises an amino acid sequence having from 1 to 20 or having from 1 to 10 amino acid modifications with respect to SEQ ID NO: 117, SEQ ID NO: 147, SEQ ID NO: 148, SEQ ID NO: 149, SEQ ID NO: 150, and SEQ ID NO: 163, the amino acid modifications being independently selected from amino acid substitutions, deletions, and insertions. Amino acid modifications may be made to increase expression or stability of the enzyme in the microbial cell, or to increase productivity of the enzyme for particular substrates.

In some embodiments, at least one UGT enzyme is a circular permutant of a wild-type UGT enzyme, optionally having amino acid substitutions, deletions, and/or insertions with respect to the corresponding position of the wild-type enzyme. Circular permutants can provide novel and desirable substrate specificities, product profiles, and reaction kinetics over the wild-type enzymes. A circular permutant retains the same basic fold of the parent enzyme, but has a different position of the N-terminus (e.g., "cut-site"), with the original N- and C-termini connected, optionally by a linking sequence. For example, in the circular permutants, the N-terminal Methionine is positioned at a site in the protein other than the natural N-terminus. UGT circular permutants are described in US 2017/0332673, which is hereby incorporated by reference in its entirety. In some embodiments, at least one UTG enzyme is a circular permutant of SEQ ID NO: 146, SEQ ID NO: 164, or SEQ ID NO: 165, SEQ ID NO: 117, SEQ ID NO: 147, SEQ ID NO: 148, SEQ ID NO: 149, SEQ ID NO: 150, and SEQ ID NO: 163. In some embodiments, the circular permutant further has one or more amino acid modifications (e.g., amino acid substitutions, deletions, and/or insertions) with respect to the parent UGT enzyme. In these embodiments, the circular permutant will have at least about 70%, or at least about 80%, or at least about 90%, or at least about 95%, or at least about 98% identity to the parent enzyme, when the corresponding amino acid sequences are aligned (i.e., without regard to the new N-terminus of the circular permutant).

Figure 8:
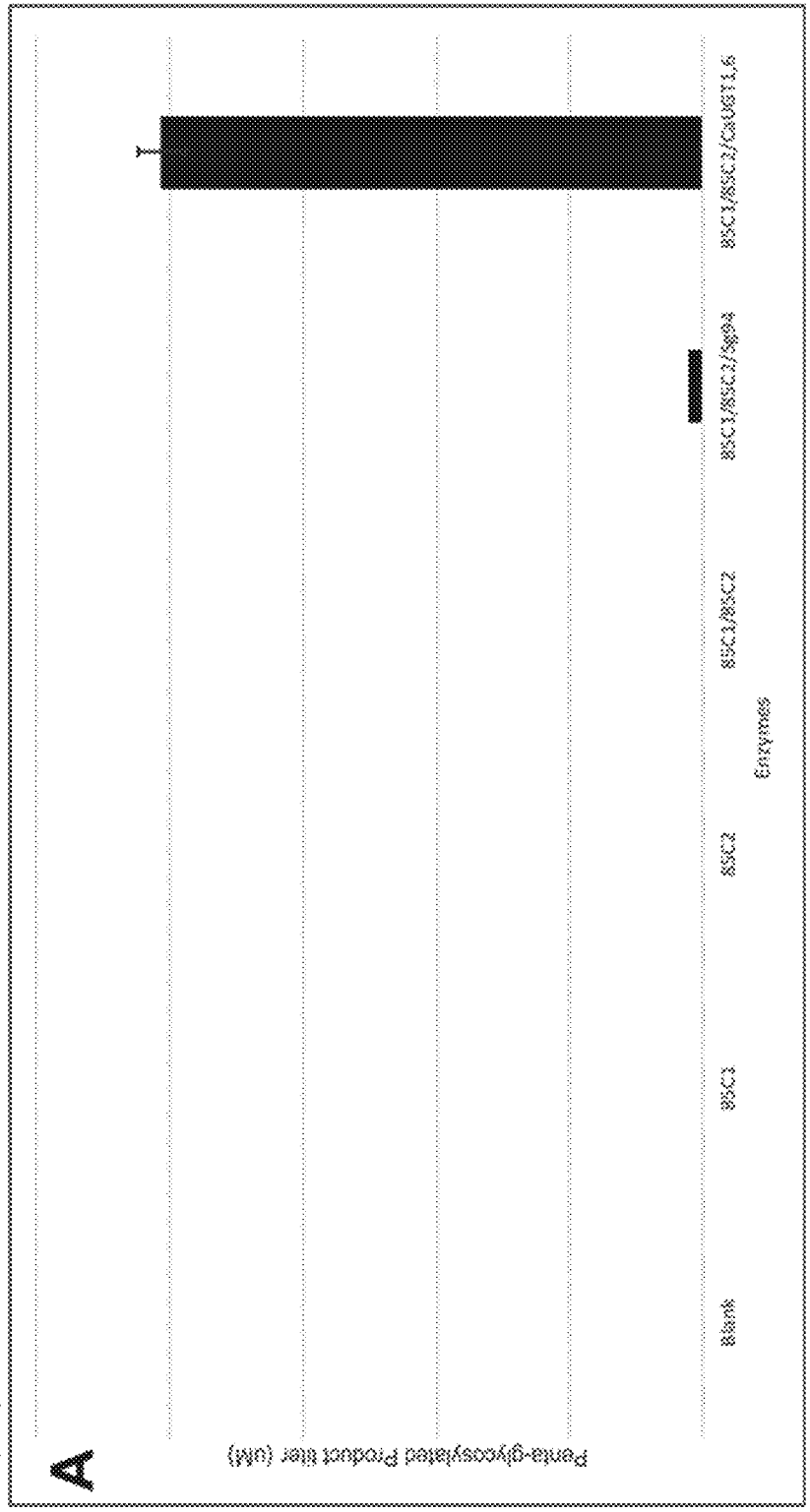
FIG. 8 shows Mogroside V production using a combination of different enzymes. (A) Penta-glycosylated products are observed when 85C1, 85C2, and Sg94_3 or CaUGT_1,6 are incubated together with mogrol as a substrate. Mogroside substrates were incubated in Tris buffer containing magnesium chloride, beta-mercaptoethanol, UDP-glucose, single UGT, and a phosphatase. (B) Extracted ion chromatogram (EIC) for 1285.4 Da (mogroside V+H) of reactions containing 85C1+85C2 and either Sg94_3 (solid dark grey line) or CaUGT_1,6 (light grey line) when incubated with mogroside II-E. (C) Extracted ion chromatogram (EIC) for 1285.4 Da (mogroside V+H) of reactions containing 85C1+85C2 and either Sg94_3 (solid dark grey line) or CaUGT_1,6 (light grey line) when incubated with mogrol. Abbreviation: MogV, mogroside V.
Figure 8:
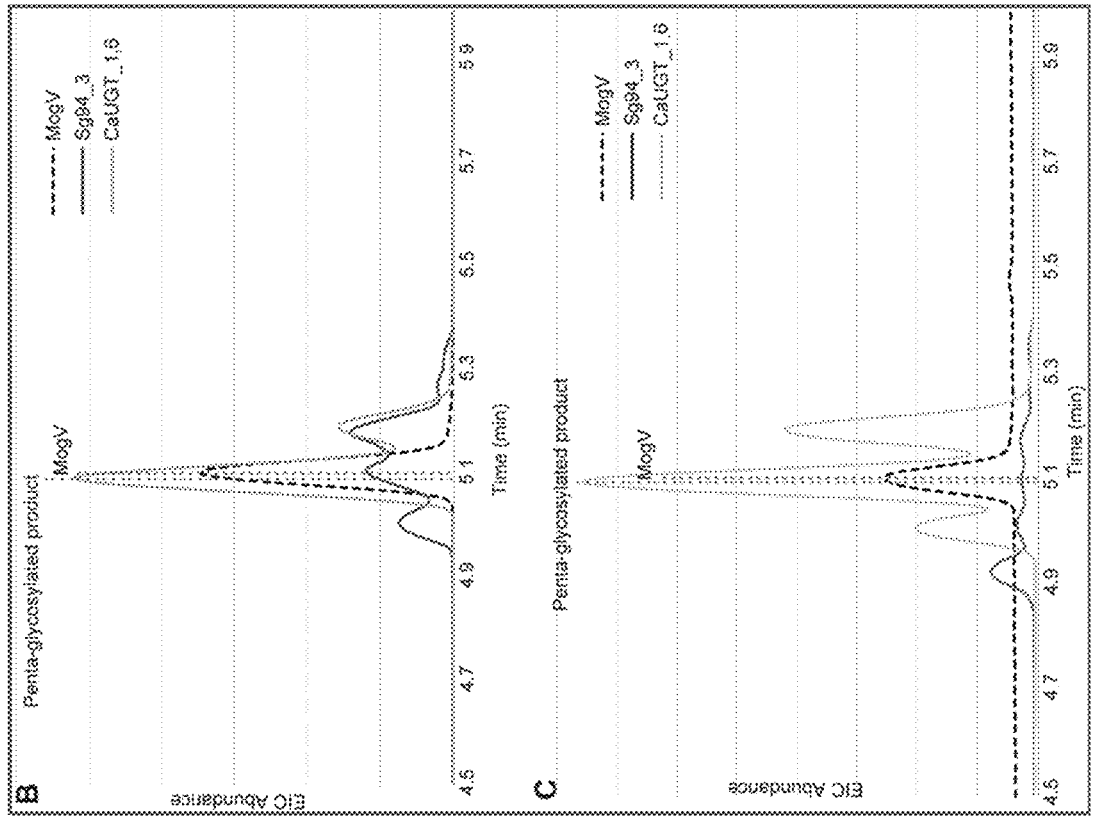

In some embodiments, the heterologous enzyme pathway comprises three or four UGT enzymes. A first UGT enzyme comprises an amino acid sequence that is at least 70% identical to *Stevia rebaudiana* UGT85C1 (SEQ ID NO: 165) (or derivative thereof as described above), or comprises an amino acid sequence that is a circular permutant of SEQ ID NO: 165 or derivative thereof (as described above). A second UGT enzyme comprises an amino acid sequence that is at least 70% identical to *Stevia rebaudiana* UGT85C2 (SEQ ID NO: 146) (or derivative as described above), or comprises an amino acid sequence that is a circular permutant of SEQ ID NO: 146 (or derivative as described above). A third UGT enzyme comprises an amino acid sequence that is at least 70% identical to *Siraitia grosvenorii* UGT94-289-3 (SEQ ID NO: 117) (or derivative or circular permutant as described above). In some embodiments, UGT94-289-3 is replaced with another UGT enzyme capable of beta 1,2 glucosyltransferase activity (as described above), together with a fourth UGT enzyme. The fourth UGT enzyme comprises an amino acid sequence that is at least 70% identical to CaUGT_1,6 (SEQ ID NO: 164) (or derivative as described above), or comprises an amino acid sequence that is a circular permutant of SEQ ID NO: 164 (or derivative as described above). Expression of these enzymes in the host cell converts mogrol to predominately tetra and pentaglycosylated products, including Mog. V. See FIG. 4, FIG. 8, FIG. 9.

In some embodiments, the microbial host cell has one or more genetic modifications that increase the production of UDP-glucose, the co-factor employed by UGT enzymes. These genetic modifications may include one or more, or two or more (or all) of ΔgalE, ΔgalT, ΔgalK, ΔgalM, ΔushA, Δagp, Δpgm, duplication of *E coli* GALU, expression of *Bacillus subtillis* UGPA, and expression of *Bifidobacterium adolescentis* SPL.

Mogrol glycosides can be recovered from the microbial culture. For example, mogrol glycosides may be recovered from microbial cells, or in some embodiments, are predominately transported into the extracellular media, where they may be recovered or sequestered.

In some aspects, the invention provides a method for making a pentaglycosylated or hexaglycosylated mogroside. In some embodiments, the mogroside is Mog V. In various embodiments, the invention comprises reacting a mogrol glycoside with a plurality of uridine diphosphate dependent glycosyltransferase (UGT) enzymes. For example, in some embodiments, one UGT enzyme comprises an amino acid sequence that is at least 70% identical to SEQ ID NO: 164, where the UGT enzyme catalyzes beta 1,6 addition of a glucose. Alternatively, the UGT enzyme comprises an amino acid sequence that is a circular permutant of SEQ ID NO: 164 or a derivative thereof (described above).

In some embodiments, the UGT enzyme comprises an amino acid sequence that is at least 80%, or at least 85%, or at least 90%, or at least 95%, or at least 98%, or at least 99% identical to SEQ ID NO: 164. For example, the UGT enzyme may comprise an amino acid sequence having from 1 to 20 or from 1 to 10 amino acid modifications with respect to SEQ ID NO: 164, the amino acid modifications being independently selected from amino acid substitutions, deletions, and insertions. In some embodiments, the UGT enzyme is a circular permutant of SEQ ID NO: 164, or derivative thereof. Amino acid modifications may be made to increase expression or stability of the enzyme in the microbial cell, or to increase productivity of the enzyme for particular mogroside substrates, such as Mog. IV or Siamenoside.

Other UGT enzymes will be coexpressed to glycosylate the desired substrate to Mog. V.

In some embodiments, the mogrol glycoside substrate comprises Mog. IIE. In some embodiments, the Mog. IIE is the glycosyltransferase product of a reaction of mogrol or Mog. IE with a UGT enzyme comprising an amino acid sequence that has at least 70% identity to UGT85C1 (SEQ ID NO: 165), or a circular permutant comprising an amino acid sequence that is a circular permutant of SEQ ID NO: 165, including derivatives of UGT85C1 or circular permutants as described. In some embodiments, the UGT enzyme comprises an amino acid sequence that is at least 80%, or at least 85%, or at least 90%, or at least 95%, or at least 98%, or at least 99% identical to SEQ ID NO: 165. For example, the UGT enzyme may comprise an amino acid sequence having from 1 to 20 or from 1 to 10 amino acid modifications with respect to SEQ ID NO: 165, the amino acid modifications being independently selected from amino acid substitutions, deletions, and insertions with respect to corresponding positions in SEQ ID NO: 165.

In some embodiments, the Mog. IIE is the glycosyltransferase product of a reaction of mogrol or Mog. IA or Mog. IE with a UGT enzyme comprising an amino acid sequence that has at least 70% identity to UGT85C2 (SEQ ID NO: 146), or a derivative or circular permutant of UGT85C2 as described herein. In some embodiments, the UGT enzyme comprises an amino acid sequence that is at least 80%, or at least 85%, or at least 90%, or at least 95%, or at least 98%, or at least 99% identical to SEQ ID NO: 146. For example, the UGT enzyme comprises an amino acid sequence having from 1 to 20 or from 1 to 10 amino acid modifications with respect to SEQ ID NO: 146, the amino acid modifications being independently selected from amino acid substitutions, deletions, and insertions with respect to corresponding positions in SEQ ID NO: 146.

In some embodiments, the mogrol is reacted with about four UGT enzymes. A first UGT enzyme comprises an amino acid sequence that is at least 70% identical to *Stevia rebaudiana* UGT85C1 (SEQ ID NO: 165), or a derivative of circular permutant as described. A second UGT enzyme comprises an amino acid sequence that is at least 70% identical to *Stevia rebaudiana* UGT85C2 (SEQ ID NO: 146), or a derivative or circular permutant as described. A third UGT enzyme comprises an amino acid sequence that is at least 70% identical to *Coffea arabica* UGT (SEQ ID NO: 164), or a derivative or circular permutant as described. A fourth UGT enzyme is capable of catalyzing beta 1,2 addition of a glucose molecule, such as SgUGT94_289_3 (SEQ ID NO:117) or a derivative or circular permutant as described.

The mogrol glycoside can be recovered and/or purified from the reaction or culture. In some embodiments, the mogrol glycoside is Mog. V, Mog. VI, or Isomog. V.

In various embodiments, the reaction is performed in a microbial cell, and UGT enzymes are recombinantly expressed in the cell. In some embodiments, mogrol is produced in the cell by a heterologous mogrol synthesis pathway, as described herein. In other embodiments, mogrol or mogrol glycosides are fed to the cells for glycosylation. In still other embodiments, the reaction is performed in vitro using purified UGT enzyme, partially purified UGT enzyme, or recombinant cell lysates.

As described herein, the microbial host cell can be prokaryotic or eukaryotic, and is optionally a bacteria selected from *Escherichia coli, Bacillus subtilis, Corynebacterium glutamicum, Rhodobacter capsulatus, Rhodobacter sphaeroides, Zymomonas mobilis, Vibrio natriegens,* or *Pseudomonas putida*. In some embodiments, the microbial cell is a yeast selected from a species of *Saccharomyces, Pichia*, or *Yarrowia*, including *Saccharomyces cerevisiae, Pichia pastoris*, and *Yarrowia lipolytica*. In some embodiments, the microbial host cell is *E. coli*.

The bacterial host cell is cultured to produce the triterpenoid product (e.g., mogroside). In some embodiments, carbon substrates such as C1, C2, C3, C4, C5, and/or C6 carbon substrates are employed for the production phase. In exemplary embodiments, the carbon source is glucose, sucrose, fructose, xylose, and/or glycerol. Culture conditions are generally selected from aerobic, microaerobic, and anaerobic.

In various embodiments, the bacterial host cell may be cultured at a temperature between 22° C. and 37° C. While commercial biosynthesis in bacteria such as *E. coli* can be limited by the temperature at which overexpressed and/or foreign enzymes (e.g., enzymes derived from plants) are stable, recombinant enzymes may be engineered to allow for cultures to be maintained at higher temperatures, resulting in higher yields and higher overall productivity. In some embodiments, the culturing is conducted at about 22° C. or greater, about 23° C. or greater, about 24° C. or greater, about 25° C. or greater, about 26° C. or greater, about 27° C. or greater, about 28° C. or greater, about 29° C. or greater, about 30° C. or greater, about 31° C. or greater, about 32° C. or greater, about 33° C. or greater, about 34° C. or greater, about 35° C. or greater, about 36° C. or greater, or about 37° C.

In some embodiments, the bacterial host cells are further suitable for commercial production, at commercial scale. In some embodiments, the size of the culture is at least about 100 L, at least about 200 L, at least about 500 L, at least about 1,000 L, or at least about 10,000 L, or at least about 100,000 L, or at least about 500,000 L, or at least about 600,000 L. In an embodiment, the culturing may be conducted in batch culture, continuous culture, or semi-continuous culture.

In various embodiments, methods further include recovering the product from the cell culture or from cell lysates. In some embodiments, the culture produces at least about 100 mg/L, or at least about 200 mg/L, or at least about 500 mg/L, or at least about 1 g/L or at least about 2 g/L, or at least about 5 g/L, or at least about 10 g/L, or at least about 20 g/L, or at least about 30 g/L, or at least about 40 g/L of the terpenoid or terpenoid glycoside product.

In some embodiments, the production of indole (including prenylated indole) used as a surrogate marker for terpenoid production, and/or the accumulation of indole in the culture is controlled to increase production. For example, in various embodiments, accumulation of indole in the culture is controlled to below about 100 mg/L, or below about 75 mg/L, or below about 50 mg/L, or below about 25 mg/L, or below about 10 mg/L. The accumulation of indole can be controlled by balancing protein expression and activity using the multivariate modular approach as described in U.S. Pat.

No. 8,927,241 (which is hereby incorporated by reference), and/or is controlled by chemical means.

Other markers for efficient production of terpene and terpenoids, include accumulation of DOX or ME in the culture media. Generally, the bacterial strains may be engineered to accumulate less of these chemical species, which accumulate in the culture at less than about 5 g/L, or less than about 4 g/L, or less than about 3 g/L, or less than about 2 g/L, or less than about 1 g/L, or less than about 500 mg/L, or less than about 100 mg/L.

The optimization of terpene or terpenoid production by manipulation of MEP pathway genes, as well as manipulation of the upstream and downstream pathways, is not expected to be a simple linear or additive process. Rather, through combinatorial analysis, optimization is achieved through balancing components of the MEP pathway, as well as upstream and downstream pathways. Indole (including prenylated indole) accumulation and MEP metabolite accumulation (e.g., DOX, ME, MEcPP, and/or farnesol) in the culture can be used as surrogate markers to guide this process.

For example, in some embodiments, the bacterial strain has at least one additional copy of dxs and idi expressed as an operon/module; or dxs, ispD, ispF, and idi expressed as an operon or module (either on a plasmid or integrated into the genome), with additional MEP pathway complementation described herein to improve MEP carbon. For example, the bacterial strain may have a further copy of dxr, and ispG and/or ispH, optionally with a further copy of ispE and/or idi, with expressions of these genes tuned to increase MEP carbon and/or improve terpene or terpenoid titer. In various embodiments, the bacterial strain has a further copy of at least dxr, ispE, ispG and ispH, optionally with a further copy of idi, with expressions of these genes tuned to increase MEP carbon and/or improve terpene or terpenoid titer.

Manipulation of the expression of genes and/or proteins, including gene modules, can be achieved through various methods. For example, expression of the genes or operons can be regulated through selection of promoters, such as inducible or constitutive promoters, with different strengths (e.g., strong, intermediate, or weak). Several non-limiting examples of promoters of different strengths include Trc, T5 and T7. Additionally, expression of genes or operons can be regulated through manipulation of the copy number of the gene or operon in the cell. In some embodiments, expression of genes or operons can be regulated through manipulating the order of the genes within a module, where the genes transcribed first are generally expressed at a higher level. In some embodiments, expression of genes or operons is regulated through integration of one or more genes or operons into the chromosome.

Optimization of protein expression can also be achieved through selection of appropriate promoters and ribosomal binding sites. In some embodiments, this may include the selection of high-copy number plasmids, or single-, low- or medium-copy number plasmids. The step of transcription termination can also be targeted for regulation of gene expression, through the introduction or elimination of structures such as stem-loops.

Expression vectors containing all the necessary elements for expression are commercially available and known to those skilled in the art. See, e.g., Sambrook et al., Molecular Cloning: A Laboratory Manual, Second Edition, Cold Spring Harbor Laboratory Press, 1989. Cells are genetically engineered by the introduction into the cells of heterologous DNA. The heterologous DNA is placed under operable control of transcriptional elements to permit the expression of the heterologous DNA in the host cell.

In some embodiments, endogenous genes are edited, as opposed to gene complementation. Editing can modify endogenous promoters, ribosomal binding sequences, or other expression control sequences, and/or in some embodiments modifies trans-acting and/or cis-acting factors in gene regulation. Genome editing can take place using CRISPR/Cas genome editing techniques, or similar techniques employing zinc finger nucleases and TALENs. In some embodiments, the endogenous genes are replaced by homologous recombination.

In some embodiments, genes are overexpressed at least in part by controlling gene copy number. While gene copy number can be conveniently controlled using plasmids with varying copy number, gene duplication and chromosomal integration can also be employed. For example, a process for genetically stable tandem gene duplication is described in US 2011/0236927, which is hereby incorporated by reference in its entirety.

The terpene or terpenoid product can be recovered by any suitable process, including partitioning the desired product into an organic phase or hydrophobic phase. Alternatively, the aqueous phase can be recovered, and/or the whole cell biomass can be recovered, for further processing. The production of the desired product can be determined and/or quantified, for example, by gas chromatography (e.g., GC-MS). The desired product can be produced in batch or continuous bioreactor systems. Production of product, recovery, and/or analysis of the product can be done as described in US 2012/0246767, which is hereby incorporated by reference in its entirety. For example, in some embodiments, product oil is extracted from aqueous reaction medium using an organic solvent, such as an alkane such as heptane or dodecane, or vegetable oil (e.g., safflower oil) followed by fractional distillation. In other embodiments, product oil is extracted from aqueous reaction medium using a hydrophobic phase, such as a vegetable oil, followed by organic solvent extraction and fractional distillation. Terpene and terpenoid components of fractions may be measured quantitatively by GC/MS, followed by blending of fractions to generate a desired product profile.

The similarity of nucleotide and amino acid sequences, i.e. the percentage of sequence identity, can be determined via sequence alignments. Such alignments can be carried out with several art-known algorithms, such as with the mathematical algorithm of Karlin and Altschul (Karlin & Altschul (1993) Proc. Natl. Acad. Sci. USA 90: 5873-5877), with hmmalign (HMMER package, http://hmmer.wustl.edu/) or with the CLUSTAL algorithm (Thompson, J. D., Higgins, D. G. & Gibson, T. J. (1994) Nucleic Acids Res, 22, 4673-80). The grade of sequence identity (sequence matching) may be calculated using e.g. BLAST, BLAT or BlastZ (or BlastX). A similar algorithm is incorporated into the BLASTN and BLASTP programs of Altschul et al (1990) J. Mol. Biol. 215: 403-410. BLAST polynucleotide searches can be performed with the BLASTN program, score=100, word length=12.

BLAST protein searches may be performed with the BLASTP program, score=50, word length=3. To obtain gapped alignments for comparative purposes, Gapped BLAST is utilized as described in Altschul et al (1997) Nucleic Acids Res. 25: 3389-3402. When utilizing BLAST and Gapped BLAST programs, the default parameters of the respective programs are used. Sequence matching analysis may be supplemented by established homology mapping techniques like Shuffle-LAGAN (Brudno M., Bioinformatics 2003b, 19 Suppl 1:154-162) or Markov random fields.

"Conservative substitutions" may be made, for instance, on the basis of similarity in polarity, charge, size, solubility, hydrophobicity, hydrophilicity, and/or the amphipathic nature of the amino acid residues involved. The 20 naturally occurring amino acids can be grouped into the following six standard amino acid groups:

(1) hydrophobic: Met, Ala, Vat, Leu, Ile;
(2) neutral hydrophilic: Cys, Ser, Thr; Asn, Gin;
(3) acidic: Asp, Glu;
(4) basic: His, Lys, Arg;
(5) residues that influence chain orientation: Gly, Pro; and
(6) aromatic: Trp, Tyr, Phe.

As used herein, "conservative substitutions" are defined as exchanges of an amino acid by another amino acid listed within the same group of the six standard amino acid groups shown above. For example, the exchange of Asp by Glu retains one negative charge in the so modified polypeptide. In addition, glycine and proline may be substituted for one another based on their ability to disrupt α-helices. Some preferred conservative substitutions within the above six groups are exchanges within the following sub-groups: (i) Ala, Val, Leu and Ile; (ii) Ser and Thr; (ii) Asn and Gln; (iv) Lys and Arg; and (v) Tyr and Phe.

As used herein, "non-conservative substitutions" are defined as exchanges of an amino acid by another amino acid listed in a different group of the six standard amino acid groups (1) to (6) shown above.

Modifications of enzymes as described herein can include conservative and/or non-conservative mutations.

In some embodiments "rational design" is involved in constructing specific mutations in enzymes. Rational design refers to incorporating knowledge of the enzyme, or related enzymes, such as its reaction thermodynamics and kinetics, its three dimensional structure, its active site(s), its substrate(s) and/or the interaction between the enzyme and substrate, into the design of the specific mutation. Based on a rational design approach, mutations can be created in an enzyme which can then be screened for increased production of a terpene or terpenoid relative to control levels. In some embodiments, mutations can be rationally designed based on homology modeling. As used herein, "homology modeling" refers to the process of constructing an atomic resolution model of one protein from its amino acid sequence and a three-dimensional structure of a related homologous protein.

In other aspects, the invention provides a method for making a product comprising a mogrol glycoside. The method comprises producing a mogrol glycoside in accordance with this disclosure, and incorporating the mogrol glycoside into a product. In some embodiments, the mogrol glycoside is Mog. V, Mog. VI, or Isomog. V. In some embodiments, the product is a sweetener composition, flavoring composition, food, beverage, chewing gum, texturant, pharmaceutical composition, tobacco product, nutraceutical composition, or oral hygiene composition.

The product may be a sweetener composition comprising a blend of artificial and/or natural sweeteners. For example, the composition may further comprise one or more of a steviol glycoside, aspartame, and neotame. Exemplary steviol glycosides comprises one or more of RebM, RebB, RebD, RebA, RebE, and RebI.

Non-limiting examples of flavors for which the products can be used in combination include lime, lemon, orange, fruit, banana, grape, pear, pineapple, mango, bitter almond, cola, cinnamon, sugar, cotton candy and vanilla flavors. Non-limiting examples of other food ingredients include flavors, acidulants, and amino acids, coloring agents, hulking agents, modified starches, gums, texturizers, preservatives, antioxidants, emulsifiers, stabilizers, thickeners and gelling agents.

Mogrol glycosides obtained according to this invention may be incorporated as a high intensity natural sweetener in foodstuffs, beverages, pharmaceutical compositions, cosmetics, chewing gums, table top products, cereals, dairy products, toothpastes and other oral cavity compositions, etc.

Mogrol glycosides obtained according to this invention can be used in combination with various physiologically active substances or functional ingredients. Functional ingredients generally are classified into categories such as carotenoids, dietary fiber, fatty acids, saponins, antioxidants, nutraceuticals, flavonoids, isothiocyanates, phenols, plant sterols and stanols (phytosterols and phytostanols); polyols; prebiotics, probiotics; phytoestrogens; soy protein; sulfides/thiols; amino acids; proteins; vitamins; and minerals. Functional ingredients also may be classified based on their health benefits, such as cardiovascular, cholesterol-reducing, and anti-inflammatory.

Mogrol glycosides obtained according to this invention may be applied as a high intensity sweetener to produce zero calorie, reduced calorie or diabetic beverages and food products with improved taste characteristics. It may also be used in drinks, foodstuffs, pharmaceuticals, and other products in which sugar cannot be used. In addition, highly purified target mogrol glycoside(s), particularly, Mog. V, Mog. VI, or Isomog. V, can be used as a sweetener not only for drinks, foodstuffs, and other products dedicated for human consumption, but also in animal feed and fodder with improved characteristics.

Examples of products in which mogrol glycosides) may be used as a sweetening compound include, but are not limited to, alcoholic beverages such as vodka, wine, beer, liquor, and sake, etc.; natural juices; refreshing drinks; carbonated soft drinks; diet drinks; zero calorie drinks; reduced calorie drinks and foods; yogurt drinks; instant juices; instant coffee; powdered types of instant beverages; canned products; syrups; fermented soybean paste; soy sauce; vinegar; dressings; mayonnaise; ketchups; curry; soup; instant bouillon; powdered soy sauce; powdered vinegar; types of biscuits; rice biscuit; crackers; bread; chocolates; caramel; candy; chewing gum; jelly; pudding; preserved fruits and vegetables; fresh cream; jam; marmalade; flower paste; powdered milk; ice cream; sorbet; vegetables and fruits packed in bottles; canned and boiled beans; meat and foods boiled in sweetened sauce; agricultural vegetable food products; seafood; ham; sausage; fish ham; fish sausage; fish paste; deep fried fish products; dried seafood products; frozen food products; preserved seaweed; preserved meat; tobacco; medicinal products; and many others.

During the manufacturing of products such as foodstuffs, drinks, pharmaceuticals, cosmetics, table top products, and chewing gum, the conventional methods such as mixing, kneading, dissolution, pickling, permeation, percolation, sprinkling, atomizing, infusing and other methods may be used.

As used in this specification and the appended claims, the singular forms "a", "an" and "the" include plural referents unless the content clearly dictates otherwise. For example, reference to "a cell" includes a combination of two or more cells, and the like.

As used herein, the term "about" in reference to a number is generally taken to include numbers that fall within a range of 10% in either direction (greater than or less than) of the number.

Examples

The biosynthesis of mogrosides in fruit involves a number of consecutive glycosylations of the aglycone mogrol to the final sweet products, including mogroside V (Mog. V). Mog. V has a sweetening capacity that is about 250 times that of sucrose (Kasai et al., *Agric Biol Chem* (1989)). Mogrosides are reported to have health benefits as well (Li et al., *Chin J Nat Med* (2014)).

A variety of factors are promoting a surge in interest in mogrosides and monkfruit in general, including an explosion in demand for natural sweeteners, difficulties in scalable sourcing of the current lead natural sweetener, rebaudioside M (RebM) from the *Stevia* plant, the superior taste performance of mogroside V relative to other natural and artificial sweetener products on the market, and the medicinal potential of the plant and fruit.

Purified Mog. V has been approved as a high-intensity sweetening agent in Japan (Jakinovich et al., *Journal of Natural Products* (1990)) and the extract has gained GRAS status in the USA as a non-nutritive sweetener and flavor enhancer (GRAS 522). Extraction of mogrosides from the fruit can yield a product of varying degrees of purity, often accompanied by undesirable aftertaste. In addition, yields of mogroside from cultivated fruit are limited due to low plant yields and particular cultivation requirements of the plant. Mogrosides are present at ~1% in the fresh fruit and ~4% in the dried fruit. Mog. V is the main component, with a content of 0.5%-1.4% in the dried fruit. Moreover, purification difficulties limit purity for Mog. V, with commercial products from plant extracts being standardized to ~50% Mog. V. A pure Mog. V product is desirable to avoid off flavors, and will be easier to formulate into products, since Mog. V has good solubility potential. It is therefore advantageous to produce sweet mogroside compounds, such as Mog. V, via biotechnological processes.

Figure 1:
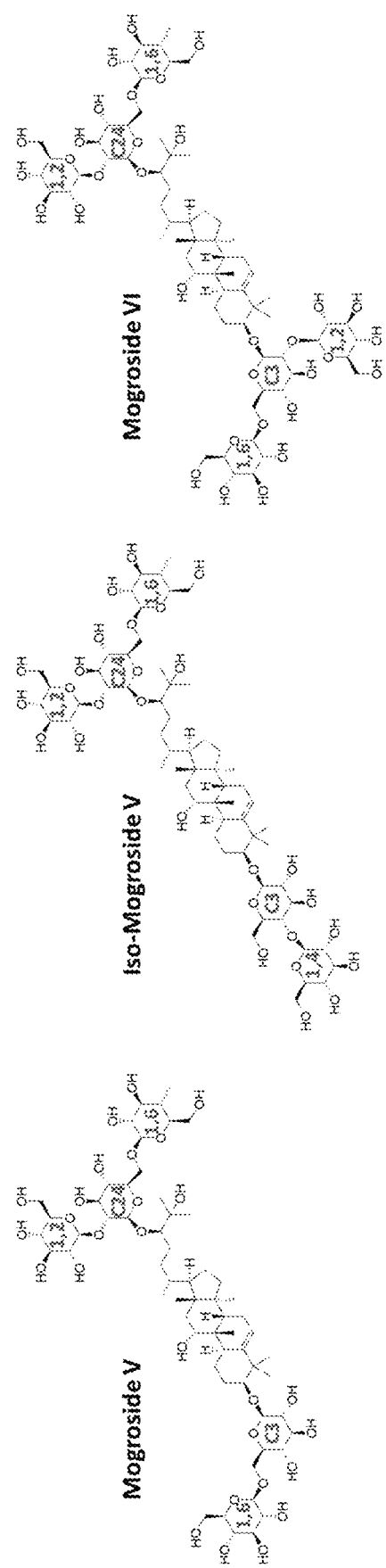
FIG. 1 shows the chemical structures of Mog. V, Mog. VI, and Isomog. V. The type of glycosylation reaction is shown within each glucose moiety (e.g., C3 or C24 core glycosylation and the 1-2, 1-4, or 1-6 glycosylation additions).

FIG. 1 shows the chemical structures of Mog. V, Mog. VI, and Isomog. V. Mog. V has five glycosylations with respect to the mogrol core, including glucosylations at the C3 and C24 hydroxyl groups, followed by 1-2, 1-4, and 1-6 glucosyl additions. These glucosylation reactions are catalyzed by uridine diphosphate-dependent glycosyltransferase enzymes (UGTs).

Figure 3:
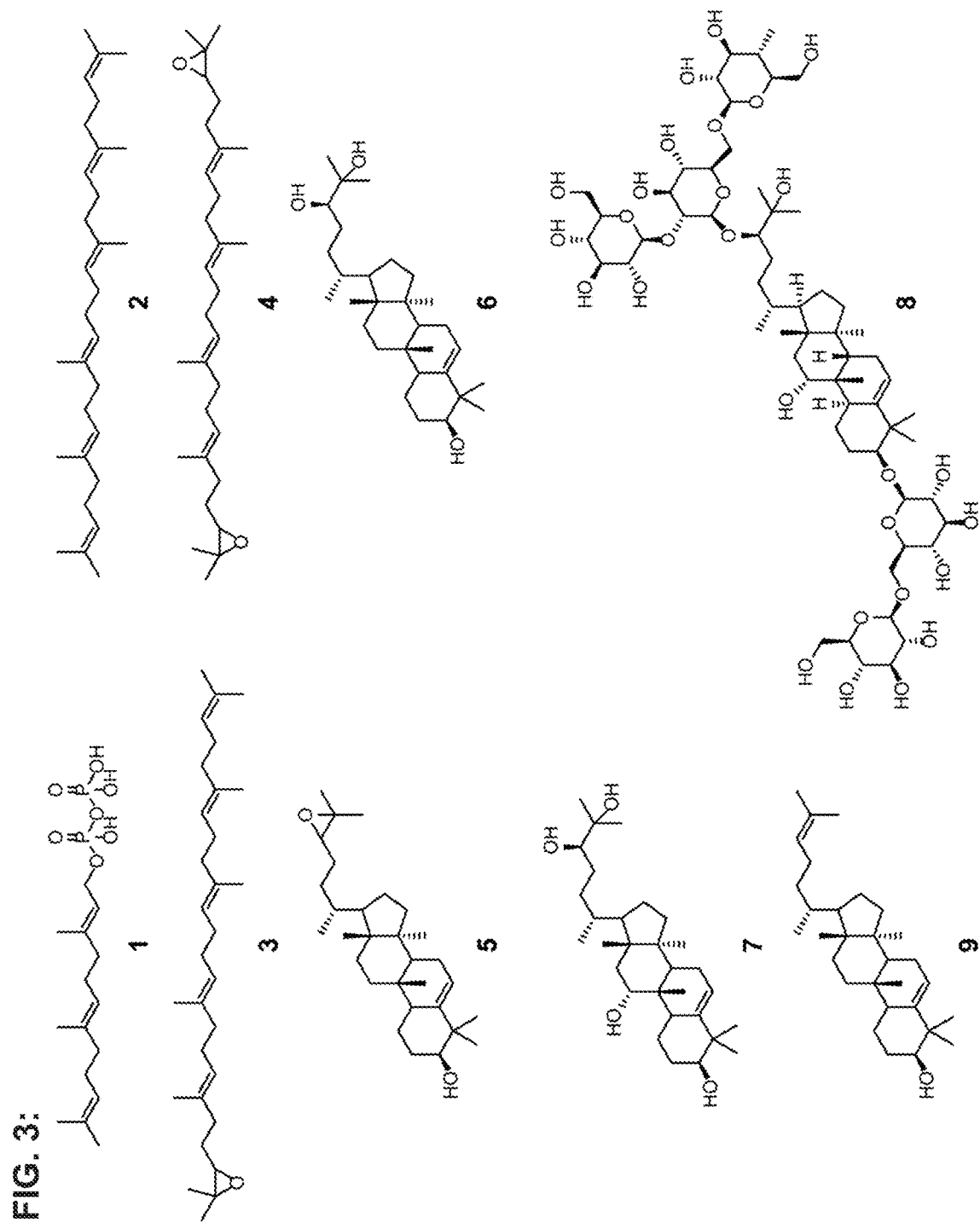
FIG. 3 depicts chemical structures of metabolites involved in mogroside V biosynthesis: (1) farnesyl pyrophosphate; (2) squalene; (3) 2,3-oxidosqualene; (4) 2,3;22,23-dioxidosqualene; (5) 24,25-epoxycucurbitadienol; (6) 24,25-dihydroxycucurbitadienol; (7) mogrol; (8) mogroside V; (9) cucurbitadienol.

FIG. 2 shows routes to Mog. V production in vivo. The enzymatic transformation required for each step is indicated, along with the type of enzyme required. Numbers in parentheses correspond to the chemical structures in FIG. 3, namely: (1) farnesyl pyrophosphate; (2) squalene; (3) 2,3-oxidosqualene; (4) 2,3:22,23-dioxidosqualene; (5) 24,25-epoxycucurbitadienol; (6) 24,25-dihydrooxycucurbitadienol; (7) mogrol; (8) mogroside V; (9) cucurbitadienol.

As illustrated in FIG. 2, mogrosides can be produced by biosynthetic fermentation processes, using microbial strains that produce high levels of MEP pathway products, along with heterologous expression of mogrol biosynthesis enzymes and UGT enzymes that direct glucosylation reactions to Mog. V, or other desired mogroside compound. For example, in bacteria such as *E. coli*, isopentenyl pyrophosphate (IPP) and dimethylallyl pyrophosphate (DMAPP) are produced from glucose, and are converted to farnesyl diphosphate (FPP) (1) by recombinant farnesyl diphosphate synthase (FPPS). FPP is converted to squalene (2) by a condensation reaction catalyzed by squalene synthase (SQS). Squalene is converted to 2,3-oxidosqualene (3) by an epoxidation reaction catalyzed by a squalene epoxidase (SQE). The pathway can proceed to 22,23-dioxidosqualene (4) by further epoxidation followed by cyclization to 24,25-epoxycucurbitadienol (5) by a triterpene cyclase, and then hydration of the remaining epoxy group to 24,25-dihydroxycucurbitadienol (6) by an epoxide hydrolase. A further hydroxylation catalyzed by a P450 oxidase produces mogrol (7).

The pathway can alternatively proceed by cyclization of (3) to produce cucurbitadienol (9), followed by epoxidation to (5), or multiple hydroxylations of cucurbitadienol to (6), or mogrol (7).

FIG. 4 illustrates glucosylation routes to Mog. V, and indicates in vitro bio-transformation activity observed for different enzymes. Glucosylation of the C3 hydroxyl produces Mog. I-E, or glucosylation of the C24 hydroxyl produces Mog. I-A1. Glucosylation of Mog. I-A1 at C3 or glucosylation of Mog. I-E1 at C24 produces Mog. II-E. Further 1-6 glucosylation of Mog. II-E at C3 produces Mog. III-A2. Further 1-6 glucosylation at C24 of Mog. IIE produces Mog. III. 1-2 glucosylation of Mog. III-A2 at C24 produces Mog. IV, and then to Mog. V with a further 1-6 glucosylation at C24. Alternatively, glucosylations may proceed through Mog. III, with a 1-6 glucosylation at C3 and a 1-2 glucosylation at C24, or through Siamenoside or Mog. IV with 1-6 glucosylations.

While biosynthetic enzymes from monkfruit (*Siraitia grosvenorii*) have been identified for production of mogrol (See, WO 2016/038617 and US 2015/0322473, which are hereby incorporated by reference in their entireties), many of these enzymes lack the productivity or physical properties desired for overexpression in microbial hosts, particularly for fermentation approaches that operate at higher temperatures than the natural climate of the plant. Accordingly, alternative enzymes are desired to improve production of mogrol using microbial fermentation, with mogrol acting as the substrate for glucosylation to produce Mog. V.

Using an *E. coli* strain that produces high levels of the MEP pathway products IPP and DMAPP (see US 2018/0245103 and US 2018/0216137, which are hereby incorporated by reference), and with overexpression of ScFPPS, enzymes were screened for their ability to convert FPP to squalene (SQS activity), as well epoxidation of squalene to produce 2,3-oxidosqualene (SQE activity). The 2,3-oxidosqualene intermediate can by cyclized by a triterpene cyclase, such as CDS from *Siraitia grosvenorii*. As demonstrated in FIG. 5, several enzymes were identified with good activity in *E. coli*. These include AaSQS, SgSQS, EsSQS, BbSQS, ElSQS, and FbSQS. In particular, AaSQS showed high activity in *E. coli* at 37° C. culture conditions.

As shown in FIG. 6, co-expression of *Artemis annua* SQS and *Methylomonas lenta* MlSQE in *E. coli* provided a substantial gain in titer of the 2,3-oxidosqualene intermediate. Other SQE enzymes were active in *E. coli*, including BaESQE, MsSQE, and MbSQE.

Figure 7:
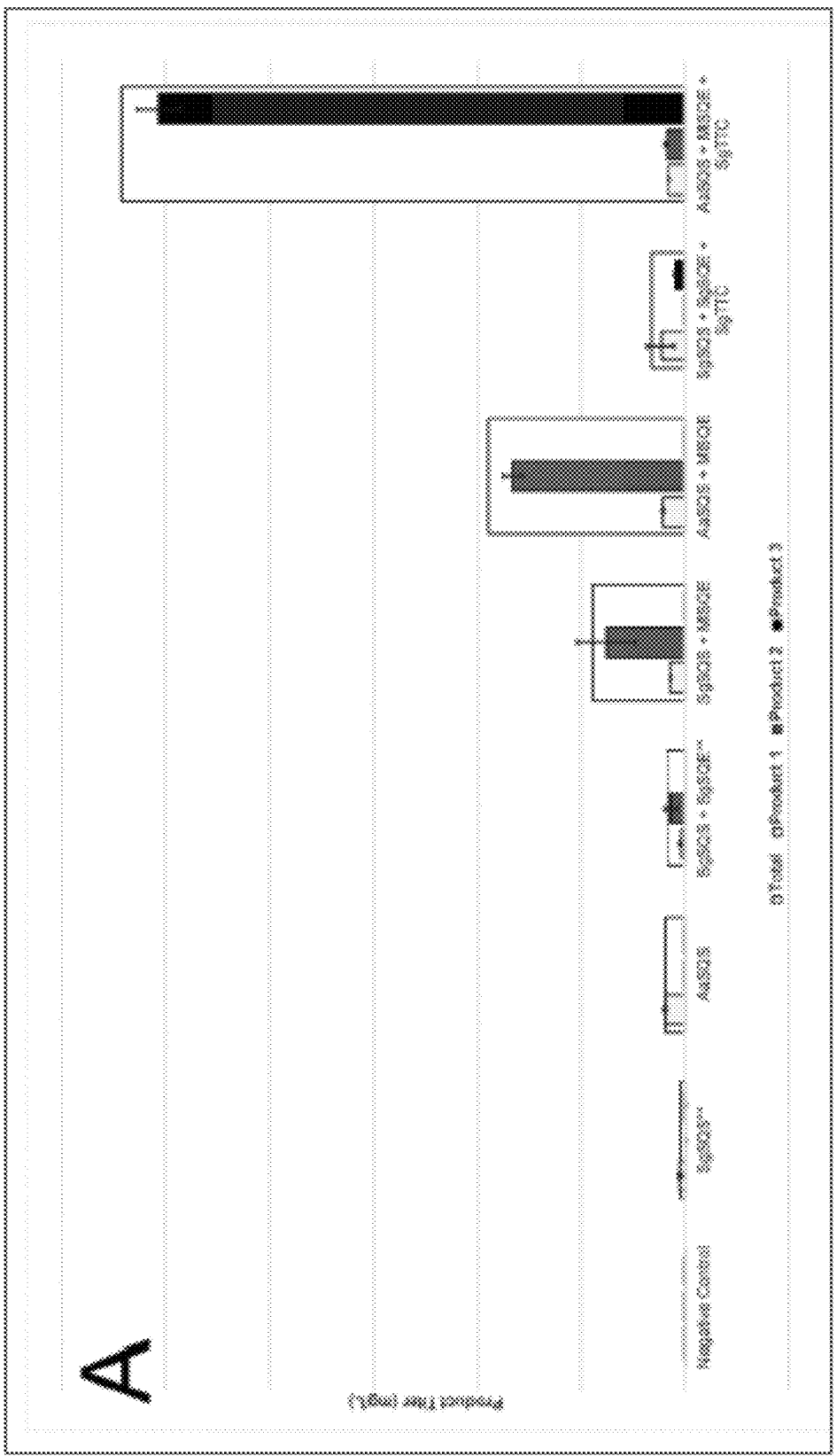
FIG. 7 shows results for in vivo production of the cyclized triterpene product. Reactions involve an increasing number of enzymes expressed in an E. coli cell line having an overexpression of MEP pathway enzymes. The asterisks represent fermentation experiments incubated for a quarter of the time than the other experiments. As shown, co-expression of AaSQS, MlSQE, and SgTTC resulted in high production of the triterpenoid product, cucurbitadienol. Abbreviations: SQS, squalene synthase; SQE, squalene epoxidase; TTC, triterpene cyclase; Sg, *Siratia grosvenorii*; Aa, *Artemesia annua*; Ml, *Methylomonas lenta*.

FIG. 7 shows coexpression of SQS, SQE, and TTC enzymes. *Siraitia grosvenorii* CDS (or triterpene cyclase, or "TTC"), when coexpressed with AaSQS and MlSQE, resulted in high production of the triterpenoid product, cucurbitadienol (Product 3). These fermentation experiments were performed at 37° C. for 48 to 120 hours.

Mogrol was used as a substrate for in vitro glucosylation reactions with candidate UGT enzymes, to identify candidate enzymes that provide efficient glucosylation of mogrol to Mog. V. Reactions were carried out in 50 mM Tris-HCl buffer (pH 7.0) containing beta-mercaptoethanol (5 mM), magnesium chloride (400 uM), substrate (200 uM), UDP-glucose (5 mM), and a phosphatase (1 U). Results are shown in FIG. 8A. Mog. V product is observed when the UGT enzymes 85C1 (*S. rebaudiana*), 85C2 (*S. rebaudiana*), and UGTSg94_3 are incubated together. A penta-glycosylated product is formed when the UGT enzymes 85C1 (*S. rebaudiana*), 85C2 (*S. rebaudiana*), and CaUGT_1,6 are incubated together. FIG. 8B, Extracted ion chromatogram (EIC) for 1285.4 Da (mogroside V+H) of reactions containing 85C1+85C2 and either Sg94_3 (solid dark grey line) or CaUGT_1,6 (light grey line) when incubated with mogroside II-E. FIG. 8C, Extracted ion chromatogram (EIC) for 1285.4 Da (mogroside V+H) of reactions containing 85C1+85C2 and either Sg94_3 (solid dark grey line) or CaUGT_1,6 (light grey line) when incubated with mogrol. Abbreviation: MogV, mogroside V.

Figure 9:
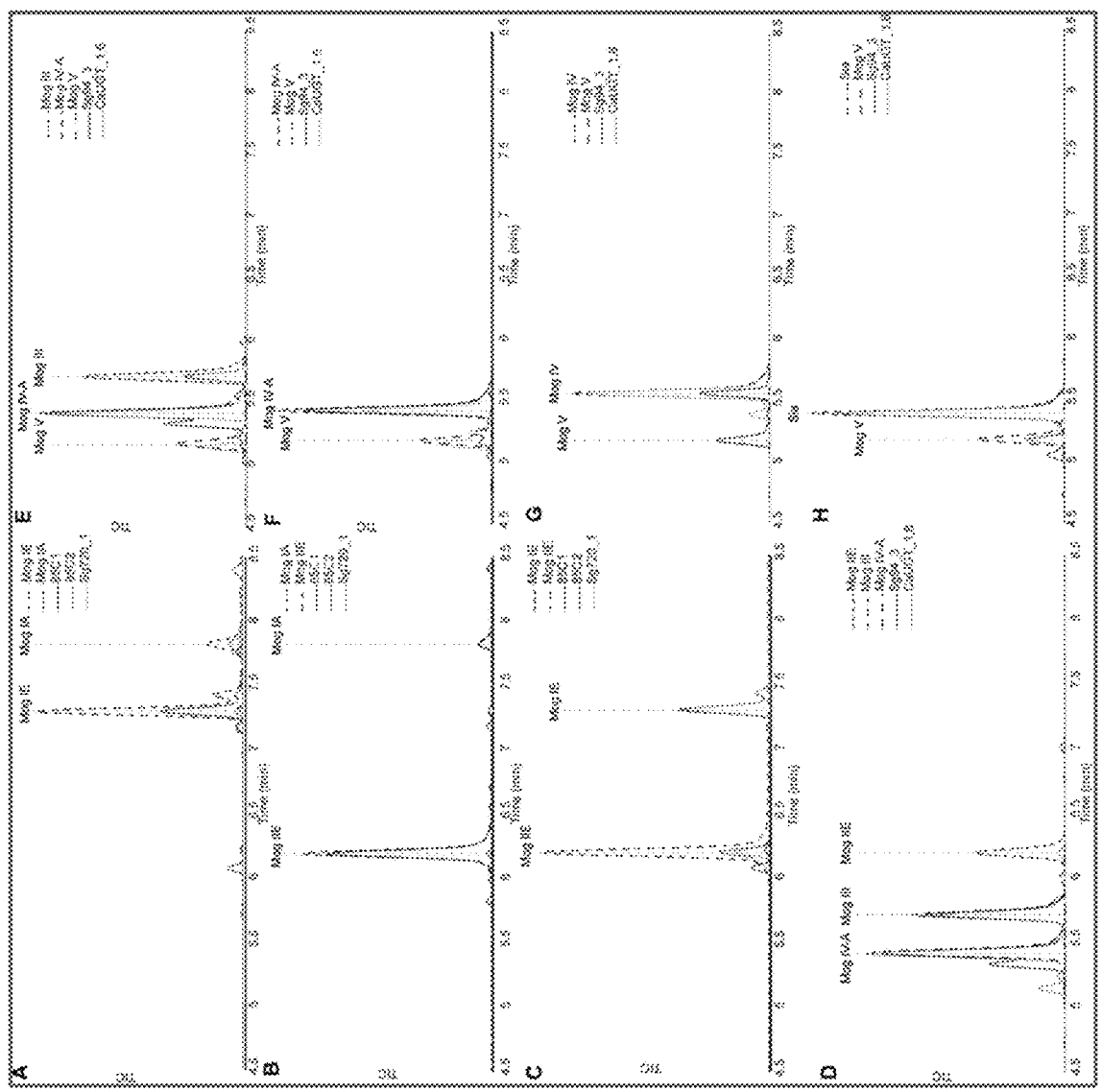
FIG. 9 shows in vitro assays showing the conversion of mogroside substrates to more glycosylated products. Mogroside substrates were incubated in Tris buffer containing magnesium chloride, beta-mercaptoethanol, UDP-glucose, single UGT, and a phosphatase. The panels correspond to the use of different substrates: (A) mogrol; (B) mogroside I-A; (C) mogroside I-E; (D) mogroside II-E; (E) mogroside III; (F) mogroside IV-A; (G) mogroside IV; (H) siamenoside.

FIG. 4 and FIG. 9 show additional glycosyltransferase activities observed on particular substrates. Coexpression of UGT enzymes can be selected to move product to any desired mogroside product.

FIG. 10 is an amino acid alignment of CaUGT_1,6 and SgUGT94_289_3 using Clustal Omega (Version CLUSTAL O (1,2,4). These sequences share 54% amino acid identity. *Coffea arabica* UGT_1,6 is predicted to be a beta-D-glucosyl crocetin beta 1,6-glucosyltransferase-like (XP_027096357.1). Together with known UGT structures and primary sequences, CaUGT_1,6 can be further engineered for microbial expression and activity, including engineering of a circular permutant.

Biosynthesis enzymes can be further engineered for expression and activity in microbial cells, using known structures and primary sequences. FIG. 11 is an amino acid alignment of *Homo sapiens* squalene synthase (HsSQS) (NCBI accession NP_004453.3) and AaSQS (SEQ ID NO: 11) using Clustal Omega (Version CLUSTAL O (1.2.4)). HsSQS has a published crystal structure (PDB entry: 1EZE). These sequences share 42% amino acid identity. FIG. 12 is an amino acid alignment of *Homo sapiens* squalene epoxidase (HsSQE) (NCBI accession XP_011515548) and MlSQE (SEQ ID NO: 39) using Clustal Omega (Version CLUSTAL O (1.2.4)). HsSQE has a published crystal structure (PDB entry: 6C6N). These sequences share 35% amino acid identity.

```
SEQUENCES
Farnesyl Pyrophosphate Synthase (FPPS)
Saccharomyces cerevisiae FPPS
                                                    (SEQ ID NO: 1)
MASEKEIRRERFLNVFPKLVEELNASLLAYGMPKEACDWYAHSLNYNTPGGKLNRGLSVVDTYA

ILSNKTVEQLGQEEYEKVAILGWCIELLQAYFLVADDMMDKSITRRGQPCWYKVPEVGEIAIND

AFMLEAAIYKLLKSHFRNEKYYIDITELFHEVTFQTELGQLMDLITAPEDKVDLSKFSLKKHSF

IVTFKTAYYSFYLPVALAMYVAGITDEKDLKQARDVLIPLGEYFQIQDDYLDCFGTPEQIGKIG

TDIQDNKCSWVINKALELASAEQRKTLDENYGKKDSVAEAKCKKIFNDLKIEQLYHEYEESIAK

DLKAKISQVDESRGFKADVLTAFLNKVYKRSK

Squalene Synthase (SQS)
Siraitia grosvenorii SQSa
                                                    (SEQ ID NO: 2)
MGSLGAILRHPDDFYPLLKLKMAARHAEKQIPPEPHWGFCYTMLHKVSRSFALVIQQLAPELRN

AICIFYLVLRALDTVEDDTSIQTDIKVPILKAFHCHIYNRDWHFSCGTKDYKVLMDQFHHVSTA

FLELGKGYQEAIEDITKRMGAGMAKFICKEVETVDDYDEYCHYVAGLVGLGLSKLFHASDLEDL

APDSLSNSMGLLLQKTNIIRDYLEDINEIPKSRMFWPREIWGKYADKLEDFKYEENSVKAVQCL

NDLVTNALNHVEDCLKYMSNLRDLSIFRFCAIPQIMAIGTLALCYNNVEVFRGVVKMRRGLTAK

VIDRTQTMADVYGAFFDFSVMLKAKVNSSDPNATKTLSRIEAIQKTCEQSGLLNKRKLYAVKSE

PMFNPTLIVILFSLLCIILAYLSAKRLPANQPV

Siraitia grosvenorii SQSb
                                                    (SEQ ID NO: 3)
MGSLGAILRHPDDFYPLLKLKMAARHAEKQIPPEPHWGFCYTMLHKVSRSFALVIQQLAPELRN

AICIFYLVLRALDTVEDDTSIQTDIKVPILKAFHCHIYNRDWHFSCGTKDYKVLMDQFHHVSTA

FLELGKGYQEAIEDITKRMGAGMAKFICKEVETVDDYDEYCHYVAGLVGLGLSKLFHASDLEDL

APDSLSNSMGLLLQKTNIIRDYLEDINEIPKSRMFWPREIWGKYADKLEDFKYEENSVKAVQCL

NDLVTNALNHVEDCLKYMSNLRDLSIFRFCAIPQIMAIGTLALCYNNVEVFRGVVKMRRGLTAK

VIDRTQTMADVYGAFFDFSVMLKAKVNNSDPNATKTLSRIEAIQKTCEQSGLLNKRKLYAVKSE

PMFNPTLIVILFSLLCIILAYLSAKRLPANQPV

Cucumis sativus
                                                    (SEQ ID NO: 4)
MGSLGAILKHPDDFYPLLKLKIAARHAEKQIPPEPHWGFCYTMLHKVSRSFALVIQQLKPELRN
```

-continued

```
AVCIFYLVLRALDTVEDDTSIQTDIKVPILKAFHCHIYNRDWHFSCGTKDYKVLMDEFHHVSTA
FLELGKGYQEAIEDITKRMGAGMAKFICKEVETVDDYDEYCHYVAGLVGLGLSKLFHAAELEDL
APDSLSNSMGLFLQKTNIIRDYLEDINEIPKSRMFWPREIWGKYADKLEDFKYEENSVKAVQCL
NDLVTNALNHVEDCLKYMSNLRDLSIFRFCAIPQIMAIGTLALCYNNVEVFRGVVKMRRGLTAK
VIDRTKTMADVYGAFFDFSVMLKAKVNSNDPNASKTLSRIEAIQKTCKQSGILNRRKLYVVRSE
PMFNPAVIVILFSLLCIILAYLSAKRLPANQSV
```

*Cucumis melo*

(SEQ ID NO: 5)
```
MGSLGAILKHPDDFYPLLKLKMAARHAEKQIPPESHWGFCYTMLHKVSRSFALVIQQLKPELRN
AVCIFYLVLRALDTVEDDTSIQTDIKVPILKAFHCHIYNRDWHFSCGTKDYKVLMDEFHHVSTA
FLELGKGYQEAIEDITKRMGAGMAKFICKEVETVDDYDEYCHYVAGLVGLGLSKLFHAAELEDL
APDSLSNSMGLFLQKTNIIRDYLEDINEIPKSRMFWPREIWCKYADKLEDFKYEENSVKAVQCL
NDLVTNALNHVEDCLKYMSNLRDLSIFRFCAIPQIMAIGTLALCYNNVEVFRGVVKMRRGLTAK
VIDRTKTMADVYGAFFDFSVMLKAKVNSNDPNASKTLSRIEAIQQTCQQSGLMNKRKLYVVRSE
PMYNPAVIVILFSLLCIILAYLSAKRLPANQSV
```

*Cucumis melo*

(SEQ ID NO: 6)
```
MGSLGAILKHPDDFYPLLKLKMAARHAEKQIPPESHWGFCYTMLHKVSRSFALVIQQLKPELRN
AVCIFYLVLRALDTVEDDTSIQTDIKVPILKAFHCHIYNRDWHFSCGTKDYKVLMDEFHHVSTA
FLELGKGYQEAIEDITKRMGAGMAKFICKEVETVDDYDEYCHYVAGLVGLGLSKLFHAAELEDL
APDSLSNSMGLFLQKTNIIRDYLEDINEIPKSRMFWPREIWGKYADKLEDFKYEENSVKAVQCL
NDLVTNALNHVEDCPKYMSNLRDLSIFRFCAIPQIMAIGTLALCYNNVEVFRGVVKMRRGLTAK
VIDRTKTMADVYGAFFDFSVMLKAKVNSNDPNASKTLSRIEAIQQTCQQSGLMNKRKLYVVRSE
PMYNPAVIVILFSLLCIILAYLSAKRLPANQSV
```

*Cucurbita moschata*

(SEQ ID NO: 7)
```
MGSLGAILRHPDDIYPLLKLKMAARHAEKQIPPESHWGFCYTMLHKVSRSFALVIQQLKPELRN
AVCIFYLVLRALDTVEDDTSIQTDIKVPILKAFHCHIYNRDWHFSCGTKDYKVLMDEFHHVSTA
FLELGRGYQEAIEDITKRMGAGMAKFICKEVETVEDYDEYCHYVAGLVGLGLSKLFHASKSENL
APDSLSNSMGLFLQKTNIIRDYLEDINEIPKSRMFWPREIWSKYADKLEDFKYEKNSVKAVQCL
NDLVTNALTHVEDCLEYMSNLKDLSIFRFCAIPQIMAIGTLALCYNNVDVFRGVVKMRRGLTAK
VIYRTKTMADVYGAFFDFSVMLKAKVNSSDPNASKTLTRIEAIQKTCKQSGLLNKRELYAVRSE
PMCNPAAIVVLFSLLCIILAYLSAKLLPANQPV
```

*Sechium edule*

(SEQ ID NO: 8)
```
MGSLGAILSHPDDLYPLLKLKMAAKHAEKQIPPDPHWGFCFSMLHKVSRSFALVIQQLKPELRN
AVCIFYLVLRALDTVEDDTGIHPDIKVPILQAFHCHIYNRDWHFSCGTKHYKVLMDEFHHVSTA
FLELGKGYQEAIEDVTERMGAGMAKFICKEVETVDDYDEYCHYVAGLVGLGLSKLFHAAELEDL
APDSLSNSMGLFLQKTNIIRDYLEDINEIPKSRMFWPREIWNKYADKLEDFKYEENSVKAVQCL
NDLVTNALNHVEDCLKYMSNLKDLSTFRFCAIPQIMAIGTLALCYDNVEVFRGVVKMRRGLTAK
IIDRTKKIADVYGAFFDFSVMLKAKVNSSDPNAAKTLSRIEAIEKTCKESGLLNKRKLYVIRSE
PLFNPAVLVILFSLICILLAYLSAKRLPANQPV
```

*Panax quinquefolius*

(SEQ ID NO: 9)
```
MGSLGAILKHPDDFYPLLKLKFAARHAEKQIPPEPHWAFCYSMLHKVSRSFGLVIQQLGPQLRD
```

-continued

```
AVCIFYLVLRALDTVEDDTSIPTEVKVPILMAFHRHIYDKDWHFSCGTKEYKVLMDEFHHVSNA

FLELGSGYQEAIEDITMRMGAGMAKFICKEVETIDDYDEYCHYVAGLVGLGLSKLFHASGAEDL

ATDSLSNSMCLFLQKTNIIRDYLEDINEIPKSRMFWPRQIWSKYVDKLEDLKYEENSAKAVQCL

NDMVTDALVHAEDCLKYMSDLRDPAIFRFCAIPQIMAIGTLALCFNNTQVFRGVVKMRRGLTAK

VIDRTKTMSDVYGAFFDFSCLLKSKVDNNDPNATKTLSRLEAIQKTCKESGTLSKRKSYIIESE

SGHNSALIAIIFIILAILYAYLSSNLLLNKQ
```

Malus domestica
(SEQ ID NO: 10)
```
MGALSTMLKHPDDIYPLLKLKIASRQIEKQIPAEPHWAFCYTMLQKVSRSFALVIQQLGTELRN

AVCLFYLVLRALDTVEDDTSVATDVKVPILLAFHRHIYDPDWHFACGTNNYKVLMDEFHHVSTA

FLELGTGYQEAIEDITKRMGAGMAKFILKEVETIDDYDEYCHYVAGLVGLGLSKLFHAAGKEDL

ASDSLSNSMGLFLQKTNIIRDYLEDINEIPKSRMFWPRQIWSKYVNKLEDLKYEENSEKAVQCL

NDMVTNALIHMEDCLKYMAALRDPAIFKFCAIPQIMAIGTLALCYNNIEVFRGVVKMRRGLTAK

VIDRTKSMDDVYGAFFDFSSILKSKVDKNDPNATKTLSRVEAVQKLCRDSGALSKRKSYIANRE

QSYNSTLIVALFIILAIIYAYLSASPRI
```

Artemisia annua
(SEQ ID NO: 11)
```
MSSLKAVLKHPDDFYPLLKLKMAAKKAEKQIPSQPHWAFSYSMLHKVSRSFALVIQQLNPQLRD

AVCIFYLVLRALDTVEDDTSIAADIKVPILIAFHKHIYNRDWHFACGTKEYKVLMDQFHHVSTA

FLELKRGYQEAIEDITMRMGAGMAKFICKEVETVDDYDEYCHYVAGLVGIGLSKLFHSSGTEIL

FSDSISNSMGLFLQKTNIIRDYLEDINEIPKSRMFWPREIWSKYVNKLEDLKYEENSEKAVQCL

NDMVTNALIHIEDCLKYMSQLKDPAIFRFCAIPQIMAIGTLALCYNNIEVFRGVVKLRRGLTAK

VIDRTKTMADVYQAFSDFSDMLKSKVDMHDPNAQTTITRLEAAQKICKDSGTLSNRKSYIVKRE

SSYSAALLALLFTILAILYAYLSANRPNKIKFTL
```

Glycine soja
(SEQ ID NO: 12)
```
MDQRSEDEFYPLLKLKIVARNAEKQIPPEPHWAFCYTMLHKVSRSFALVIQQLGIELRNAVCIF

YLVLRALDTVEDDTSIETDVKVPILIAFHRHIYDRDWHFSCGTKEYKVLMGQFHHVSTAFLELG

KNYQEAIEDITKRMGAGMAKFICKEVETIDDYDEYCHYVAGLVGLGLSKLFHASGSEDLAPDDL

SNSMGLFLQKTNIIRDYLEDINEIPKSRMFWPRQIWSEYVNKLEDLKYEENSVKAVQCLNDMVT

NALMHAEDCLTYMAALRDPPIFRFCAIPQIMAIGTLALCYNNIEVFRGVVKMRRGLTAKVIDRT

KTMADVYGAFFDFASMLEPKVDKNDPNATKTLSRLEAIQKTCRESGLLSKRKSYIVNDESGYGS

TMIVILVIMVSIIFAYLSANHHNS
```

Diospyros kaki
(SEQ ID NO: 13)
```
MGSLAAMLRHPDDVYPLVKLKMAARHAEKQIPPEPHWAFCYTMLHKVSRSFGLVIQQLGTELRN

AVCIFYLVLRALDTVEDDTSIATEVKVPILLAFHHHIYDRDWHFSCGTREYKVLMDEFHHVSTA

FLELGKGYQEAIEDITMRMGAGMAKFICKEVETIDDYDEYCHYVAGLVGLGLSKLFHASGLEDL

APDSLSNSMCLFLQKTNIIRDYLEDINEIPKSRMFWPRQIWSKYVNKLEDLKYEKNSVKSVQCL

NDMVTNALIHVDDCLKYMSALRDPAIFRFCAIPQIMAIGTLALCYNNIEVFRGVVKMRRGLTAK

VIDQTKTISDVYGAFFDFSCMLKSKVEKNDPNSTKTLSRIEAIQKTCRESGTLSKRKSYILRSK

RTHNSTLIFVLFIILAILFAYLSANRPPINM
```

Euphorbia lathyris
(SEQ ID NO: 14)
```
MGSLGAILKHPDDFYPLLKLKMAAKHAEKQIPAQPHWGFCYSMLHKVSRSFSLVIQQLGTELRD

AVCIFYLVLRALDTVEDDTSIPTDVKVPILIAFHKHIYDPEWHFSCGTKEYKVLMDQIHHLSTA
```

-continued

FLELGKSYQEAIEDITKKMGAGMAKFICKEVETVDDYDEYCHYVAGLVGLGLSKLFDASGFEDL

APDDLSNSMGLFLQKTNIIRDYLEDINEIPKSRMFWPRQIWSKYVNKLEDLKYEENSVKAVQCL

NDMVTNALIHMDDCLKYMSALRDPAIFRFCAIPQIMAIGTLALCYNNVEVFRGVVKMRRGLTAK

VIDRTRTMADVYRAFFDFSCMMKSKVDRNDPNAEKTLNRLEAVQKTCKESGLLNKRRSYINESK

PYNSTMVILLMIVLAIILAYLSKRAN

*Camellia oleifera*
(SEQ ID NO: 15)
MGSLGAILKHPDDFYPLMKLKMAARRAEKNIPPEPHWGFCYSMLHKVSRSFALVIQQLDTELRN

AVCIFYLVLRALDTVEDDTSIATEVKVPILMAFHRHIYDRDWHFSCGTKEYKVLMDEFHHVSTA

FSELGRGYQEAIEDITMRMGAGMAKFICKEVETIDDYDEYCHYVAGLVGLGLSKLFHASGSEDL

ASDSLSNSMGLFLQVFLLTCIKTNIIRDYLEDINEIPKSRMFWPRQIWSKYVNKLEDLKDKENS

VKAVECLNDMVTNALIHVEDCLTYMSALRDPSIFRFCAIPQIMAIGTLALCYNNIEVFRGVVKM

RRGLTAKVIDRTKTMSDVYGGFFDFSCMLKSKVNKSDPNAMKALSRLEAIQKICRESGTLNKRK

SYIIKSEPRYNSTLVFVLFIILAILFAYL

*Eleutherococcus senticosus*
(SEQ ID NO: 16)
MGSLGAILKHPDDFYPLLKLKFAARHAEKQIPPEPHWAFCYSMLHKVSRSFGLVIQQLDAQLRD

AVCIFYLVLRALDTVEDDTSIPTEVKVPILMAFHRHIYDKDWHFSCGTKEYKVLMDEFHHVSNA

FLELGSGFQEAIEDITMRMGAGMAKFICKEVETIDDYDEYCHYVAGLVGLGLSKLFHASGAEDL

ATDSLSNSMGLFLQKTNIIRDYLEDINEIPKSRMFWPRQIWSKYVDKLENLKYEENSAKAVQCL

NDMVTNALLHAEDCLKYMSNLRDPAIFRFCAIPQIMAIGTLALCFNNIQVFRGVVKMRRGLTAK

VIDRTKTMSDVYGAFFDFSCLLKSKVDNNDPNATKTLSRLEAIQKTCKESGTLSKRKSYIIESK

SAHNSALIAIIFIILAILYAYLSSNLPNNQ

*Flavobacteriales bacterium*
(SEQ ID NO: 166)
MLNNSLFSRLEEIPALLKLKLGSKDYYKNNNSETLTCDNLRYCFDTLNKVSRSFATVIKQLPNE

LGNNVCVFYLILRALDSIEDDMNLPKELKIKLLREFHKKNYESGWNISGVGDKKEHVELLENYD

KVIQSFLAIDQKNQLIITDICRKVGAGMANFVKAEIESVEDYNLYCHHVAGLVGIGLSRMFISS

GLENDDFLNQDEISNSMCLFLQKTNIVRDYREDLDECRMFWPKDIWHVYCSKINDFAINPTHDQ

SVLCLNHMLNNALTHATDCLAYLKHLRNENIFKFCAIPQVMAMATLCKIYSNPDVFIKNVKIRK

GLAAKLILNTTSMDEVIKVYKDMLLVIESKISSDNNPVSAETIQLLKQIREYFNDETLIVRKIA

*Bacteroidetes bacterium*
(SEQ ID NO: 167)
MLNSSLFSRLEEIPALLKLKLGSINNYKNNNSENLTSKNLRYCFDTLNKVSRSFASVIKQLPNE

LMVNVCLFYLILRALDSIEDDMNLPKDFKINLLREFLDKNYEPGWKISGVGDKKEYVELLENYD

KVIQVFLDIDPKNQLIITDICRKMGAGMAHFVEAEINSVKDYNLYCYHVAGLVGIGLSKMFLAS

GLENCDYLNQEEISSSMGLFLQKTNIVRDYKEDMEENRIFWPKEIWRTYASKFSDFSINPQHET

SISCLNHMVNDALGHVIDCLEYLRHLRNENIFKFCAIPQVMAMATLCKVYNNPDVFIKTVKIRK

GLAAKLILNTTSMDEVIKVYKGLLLDIENKIPLHNPTSDETLRLIKNIRSYCNNETMVVSKTA

Squalene Epoxidase
*Siraitia grosvenorii* SQE1
(SEQ ID NO: 17)
MVDQCALGWILASALGLVIALCFFVAPRRNHRGVDSKERDECVQSAATTKGECRFNDRDVDVIV

VGAGVAGSALAHTLGKDGRRVHVIERDLTEPDRIVGELLQPGGYLKLIELGLQDCVEEIDAQRV

YGYALFKDGKNTRLSYPLENFHSDVSGRSFHNGRFIQRMREKAASLPNVRLEQGTVTSLLEEKG

TIKGVQYKSKNGEEKTAYAPLTIVCDGCFSNLRRSLCNPMVDVPSYFVGLVLENCELPFANHGH

-continued

VILGDPSPILFYQISRTEIRCLVDVPGQKVPSIANGEMEKYLKTVVAPQVPPQIYDSFIAAIDK

GNIRTMPNRSMPAAPHPTPGALLMGDAFNMRHPLTGGGMTVALSDIVVLRNLLKPLKDLSDAST

LCKYLESFYTLRKPVASTINTLAGALYKVFCASPDQARKEMRQACFDYLSLGGIFSNGPVSLLS

GLNPRPLSLVLHFFAVAIYGVGRLLLPFPSVKGIWIGARLIYSASGIIFPIIRAEGVRQMFFPA

TVPAYYRSPPVFKPIV

*Siraitia grosvenorii* SQE2
(SEQ ID NO: 18)
MVDQCALGWILASVLGAAALYFLFGRKNGGVSNERRHESIKNIATTNGEYKSSNSDGDIIIVGA

GVAGSALAYTLGKDGRRVHVIERDLTEPDRIVGELLQPGGYLKLTELGLEDCVDDIDAQRVYGY

ALFKDGKDTRLSYPLEKFHSDVAGRSFHNGRFIQRMREKAASLPKVSLEQGTVTSLLEENGIIK

GVQYKTKTGQEMTAYAPLTIVCDGCFSNLRRSLCNPKVDVPSCFVGLVLENCDLPYANHGHVIL

ADPSPILFYRISSTEIRCLVDVPGQKVPSISNGEMANYLKNVVAPQIPSQLYDSFVAAIDKGNI

RTMPNRSMPADPYPTPGALLMGDAFNMRHPLTGGGMTVALSDVVVLRDLLKPLRDLNDAPTLSK

YLEAFYTLRKPVASTINTLAGALYKVFCASPDQARKEMRQACFDYLSLGGIFSNGPVSLLSGLN

PRPISLVLHFFAVAIYGVGRLLIPFPSPKRVWIGARIISGASAIIFPIIKAEGVRQMFFPATVA

AYYRAPRVVKGR

*Momordica charantia*
(SEQ ID NO: 19)
MVDECALGWILAAALGAVIALCLFVAPKTNNQDGGVDSKATPECVQTTNGECRSDGDSDVIIVG

AGVAGSALAHTLGKDGRRVHVIERDLTEPDRIVGELLQPGGYLKLIELGLADCVEEIDAQRVYG

YALFKDGKNTRLSYPLEKFHSDVSGRSFHNGRFIQRMREKADSLPNVRLEQGTVTSLLEEKGTI

KGVQYKSKDGKEKTAYAPLTIVCDGCFSNLRRSLCNPMVDVPSCFVGLVLENCQLPFANHGHVV

LGDPSPILFYPISSTEIRCLVDVPGQKVPSISNGEMEKYLKTVVAPQVPPQIYDAFIAAIDKGN

IRTMPNRSMPAAPHPTPGALLMGDAFNMRHPLTGGGMTVALSDIVVLRNLLKPLKDLHDAPTLC

KYLESFYTLRKPVASTINTLAGALYKVFCASPDQARKEMRQACFDYLSLGGMFSNGPVSLLSGL

NPRPLSLVLHFFAVAIYGVGRLLFPFPSPKGIWIGARLIYSASGIIFPIIKAEGVRQMFFPATV

PAYYRSPPALKPVA

*Cucurbita maxima*
(SEQ ID NO: 20)
MVDYCAFGWILAAVLGLAIALSFFVSPRRNRRGGADSTPRSEGVRSSSTTNGECRSVDGDADVI

IVGAGVAGSALAHTLGKDGRLVHVIERDLTEPDRIVGELLQPGGYLKLIELGLQDCVEEIDAQK

VYGYALFKDGKNTQLSYPLEKFQSDVSGRSFHNGRFIQRMREKAASLPNVRLEQGTVTSLLEEK

GTIKGVQYKSKNGEEKTAYAPLTIVCDGCFSNLRRSLCKPMVDVPSCFVGLVLENCQLPFANHG

HVVLGDPSPILFYPISSTEIRCLVDVPGQKIPSISNGEMEKYLKTIVAPQVPPQIHDAFIAAID

KGNIRTMPNRSMPAAPQPTPGALLMGDAFNMRHPLTGGGMTVALSDIVVLRNLLKPLKDLNDAP

TLCKYLESFYTLRKPVASTINTLAGALYKVFCASPDQARKEMRQACFDYLSLGGIFSNGPVSLL

SGLNPRPLSLVLHFFAVAIYGVGRLLLPFPSPKGIWIGARLVYSASGIIFPIIKAEGVRQMFFP

ATVPAYYRSPPVHKSIA

*Cucurbita moschata*
(SEQ ID NO: 21)
MVDYCAFGWILAAVLGLAIALSFFVSPRRNRRGGADSTPRSEGVRSSSTTNGECRSVDCDADVI

IVGAGVAGSALAHTLGKDGRLVHVIERDLTEPDRIVGELLQPGGYLKLIELGLQDCVEEIDAQK

VYGYALFKDGKNTQLSYPLEKFQSDVSGRSFHNGRFIQRMREKAASLPNVRLEQGTVTSLLEEK

GTIKGVQYKSKNGEEKTAHAPLTIVCDGCFSNLRRSLCKPMVDVPSCFVGLVLENCQLPFANHG

-continued

HVVLGDPSPILFYPISSTEIRCLVDVPGQKVPSISNGEMEKYLKTIVAPQVPPQIHDAFIAAID

KGNIRTMPNRSMPAAPQPTPGALLMGDAFNMRHPLTGGGMTVALSDIVVLRNLLKPLKDLNDAP

TLCKYLESFYTLRKPVASTINTLAGALYKVFCASPDQARKEMRQACFDYLSLGGIFSNGPVSLL

SGLNPRPLSLVLHFFAVAIYGVGRLLLPFPSPKGIWIGARLVYSASGIIFPIIKAEGVRQMFFP

ATVPAYYRSPPVLKTIA

*Cucurbita moschata*
(SEQ ID NO: 22)
MMVDHCAFAWILDVVLGLVVAVTFFVAAPRRNRRGGTDSTASKDCVISTAIANGECKPDDADAE

VIIVGAGVAGSALAYTLGKDGRRVHVIERDLTEPDRIVGEFLQPGGYLKLIELGLGDCVEEIDA

QKLYCYALFKDCKNTRVSYPLCNFHSDVSCRSFHNCRFIQRMREKAASLPNVRLEQCTVTSLLE

TKGTIKGVQYKSKNGEEKTAYAPLTIVCDGCFSNLRRSLCKPMVDVPSCFVGLVLENCQLPFAN

HGHVVLGDPSPILFYPISSTEIRCLVDVPGQKVPSISNGDMEKYLKTVVAPQVPPQIHDAFIAA

IEKGNVRTMPNRSMPAAPHPTPGALLMGDAFNMRHPLTGGGMTVALSDIVVLRNLLKPLKDLND

ASTLCKYLESFYTLRKPVASTINTLAGALYKVFCASPDQARKEMRQACFDYLSLGGVFSNGPIS

LLSGLNPRPSSLVLHFFAVAIYGVGRLLLPFPSLKGIWIGARLIYSASGIILPIIKAEGVRQMF

FPATVPAYYRSPPVHKPIT

*Cucumis sativus*
(SEQ ID NO: 23)
MVDHCTFGWIFSAFLAFVIAFSFFLSPRKNRRGRGTNSTPRRDCLSSSATTNGECRSVDGDADV

IIVGAGVAGSALAHTLGKDGRRVHVIERDLTEPDRIVGELLQPGGYLKLIELGLQDCVEEIDAQ

KVYGYALFKDGKSTRLSYPLENFQSDVSGRSFHNGRFIQRMREKAAFLPNVRLEQGTVTSLLEE

KGTITGVQYKSKNGEQKTAYAPLTIVCDGCFSNLRRSLCNPMVDVPSCFVGLVLENCQLPYANL

GHVVLGDPSPILFYPISSTEIRCLVDVPGQKVPSISNGEMEKYLKTVVAPQVPPQIHDAFIAAI

EKGNIRTMPNRSMPAAPQPTPGALLMGDAFNMRHPLTGGGMTVALSDIVVLRNLLKPLKDLNDA

PTLCKYLESFYTLRKPVASTINTLAGALYKVFCASSDQARKEMRQACFDYLSLGGIFSNGPVSL

LSGLNPRPLSLVLHFFAVAIYGVGRLLLPFPSPKGIWIGARLVYSASGIIFPIIKAEGVRQMFF

PATVPAYYRTPPVFNS

*Cucumis melo*
(SEQ ID NO: 24)
MVDHCAFGWIFSALLAFPIALSLFLSPWRNRRVRGTDSTPRSASVSSSATTNGECRSVDGDADV

VIVGAGVAGSALAHTLGKDGRRVHVIERDLTEPDRIVGELLQPGGYLKLIELGLQDCVEEIDAQ

KVYGYALFKDGKNTRLSYPLENFHSDVSGRSFHNGRFIQRMREKAASLPNVRLEQGTVTSLLEE

KGTITGVQYKSKNGEQKTAYAPLTIVCDGCFSNLRRSLCTPMVDVPSYFVGLVLENCQLPYANL

GHVVLGDPSPILFYPISSTEIRCLVDVPGQKVPSISNGEMEKYLKTVVAPQVPPQIHDAFIAAI

EKGNIRTMPNRSMPAAPQPTPGALLMGDAFNMRHPLTGGGMTVALSDIVVLRNLLKPLKDLNDA

PTLCKYLESFYTLRKPVASTINTLAGALYKVFCASPDQARKEMRQACFDYLSLGGIFSNGPVSL

LSGLNPRPLSLVLHFFAVAIYGVGRLLLPFPSLKGIWIGARLVYSASGIIFPIIKAEGVRQMFF

PATVPAYYRTPPVLNS

*Cucurbita maxima*
(SEQ ID NO: 25)
MMVEHCAYGWILAAVLGLVVAVTFFVAVPRRNRRGGTDSTASKDCVISPAIANGECEPEDADAD

ADVIIVGAGVAGSALAHTLGKDGRRVHVIERDLTEPDRIVGEFLQPGGHLKLIELGLGDCVEEI

DAQKLYGYALFKDGKNTRVSYPLGNFHSDVSGRSFHNGRFIQRMREKAASLPNVRLEQGTVTSL

LEKKGTIKGVQYKSKNGEEKTAYAPLTIVCDGCFSNLRRSLCKPMVDVPSCFVGLVLENCRLPF

ANHGHVVLGDPSPILFYPISSTEIRCLVDVPGQKVPSIPNGDMEKYLKTVVAPQVPPQIHDAFI

-continued

AAIEKGNIRTMPNRSMPAAPHPTPGALLMGDAFNMRHPLTGGGMTVALSDIVVLRNLLKPLKDL

NDAPTLCKYLESYYTLRKPVASTINTLAGALYKVFCASPDQARKEMRQACFDYLSLGGVFSNGP

ISLLSGLNPRPSCLVLHFFAVAIYGVGRLLLPFPSLKGIWIGARLIYSASGIILPIIKAEGVRQ

MFFPATVPAYYRSPPVHKPIT

*Ziziphus jujube*
(SEQ ID NO: 26)
MLDQCPLGWILASVLGLFVLCNLIVKNRNSKASLEKRSECVKSIATTNGECRSKSDDVDVIIVG

AGVAGSALAHTLGKDGRRLHVIERDLTEPDRIVGELLQPGGYLKLIELGLQDCVEEIDAQRVFG

YALFKDGKDTRLSYPLEKFHSDVSGRSFHNGRFIQRMREKSASLPNVRLEQGTVTSLLEEKGTI

KGVQYKTKTGQELTAFAPLTIVCDGCFSNLRRSLCNPKVDVPSCFVGLVLENCELPYANHGHVI

LADPSPILFYPISSTEVRCLVDVPGQKVPSISNGEMAKYLKSVVAPQIPPQIYDAFIAAVDKGN

IRTMPNRSMPASPFPTPGALLMGDAFNMRHPLTGGGMTVALSDIVVLRDLLKPLGDLNDAATLC

KYLESFYTLRKPVASTINTLAGALYKVFCASPDQARKEMRQACFDYLSLGGIFSTGPVSLLSGL

NPRPLSLVLHFFAVAIYGVGRLLLPFPSPKRIWIGARLISGASGIIFPIIKAEGVRQMFFPATV

PAYYRAAPVE

*Morus alba*
(SEQ ID NO: 27)
MADPYTMGWILASLLGLFALYYLFVNNKNHREASLQESGSECVKSVAPVKGECRSKNGDADVII

VGAGVAGSALAHTLGKDGRRVHVIERDLAEPDRIVGELLQPGGYLKLIELGLQDCVEEIDSQRV

YGYALFKDGKDTRLSYPLEKFHSDVSGRSFHNGRFIQRMREKAASLPNVQLEQGTVTSLLEENG

TIKGVQYKTKTGQELTAYAPLTIVCDGCFSNLRRSLCIPKVDVPSCFVGLVLENCNLPYANHGH

VVLADPSPILFYPISSTEVRCLVDVPGQKVPSISNGEMAKYLKTVVASQIPPQIYDSFVAAVDK

GNIRTMPNRSMPAAPHPTPGALLMGDAFNMRHPLTGGGMTVALSDIVVLRDLLKPLRDLNDSVT

LCKYLESFYTLRKPVASTINTLAGALYKVFCASPDQARKEMREACFDYLSLGGVFSEGPVSLLS

GLNPRPLSLVCHFFAVAIYGVGRLLLPFPSPKRLWIGARLISGASGIIFPIIRAEGVRQMFFPA

TIPAYYRAPRPN

*Juglans regia* (JrSQE1)
(SEQ ID NO: 28)
MVDPYALGWSFASVLMGLVALYILVDKKNRSRVSSEARSEGVESVTTTTSGECRLTDGDADVII

VGAGVAGSALAHTLGKDGRRVHVIERDLTEPDRIVGELLQPGGYLKLIELGLEDCVEDIDAQRV

FGYALFKDGKNTRLSYPLEKFHSDVSGRSFHNGRFIQRMREKAASLLNVRLEQGTVTSLLEENG

TVKGVQYKTKDGNELTAHAPLTIVCDGCFSNLRRSLCNPQVDVPSSFVGLVLENCELPYANHGH

VILADPSPILFYPISSTEVRCLVDVPGKKVPSIANGEMEKYLKNMVAPQLPPEIYDSFVAAVDR

GNIRTMPNRSMPAAPHPTPGALLMGDAFNMRHPLTGGGMTVALSDIVVLRDLLKPLRDLNDAPT

LCKYLESFYTLRKPVASTINTLAGALYKVFCASPDRARKEMRQACFDYLSLGGVFSMGPVSLLS

GLNPRPLSLVLHFFAVAVYGVGRLLVPFPSPSRIWIGARLISGASAIIFPIIKAEGVRQMFFPA

TVPAYYRAPPVKRDH

*Cucumis melo*
(SEQ ID NO: 29)
MVDQCALGWILASVLGASALYLLFGKKNCGVLNERRRESLKNIATTNGECKSSNSDGDIIIVGA

GVAGSALAYTLAKDGRQVHVIERDLSEPDRIVGELLQPGGYLKLTELGLEDCVDDIDAQRVYGY

ALFKDGKDTRLSYPLEKFHSDVSGRSFHNGRFIQRMREKAASLPNVRLEQGTVTSLLEENGTIK

GVQYKNKSGQEMTAYAPLTIVCDGCFSNLRRSLCNPKVDVPSCFVGLILENCDLPYANHGHVIL

ADPSPILFYPISSTEIRCLVDVPGQKVPSISNGEMANYLKNVVAPQIPPQLYNSFIAAIDKGNI

-continued

```
RTMPNRSMPADPYPTPGALLMGDAFNMRHPLTGGGMTVALSDIVVLRDLLKPLRDLNDAPTLCK

YLEAFYTLRKPVASTINTLAGALYKVFCASPDQARKEMRQACFDYLSLGGIFSNGPVSLLSGLN

PRPLSLVLHFFAVAIYGVGRLLIPFPSPKRVWIGARLISGASAIIFPIIKAEGVRQMFFPKTVA

AYYRAPPVVRER
```

Cucumis sativus (SEQ ID NO: 30)

```
MVDQCALGWILASVLGASALYLLFGKKNCGVSNERRRESLKNIATTNGECKSSNSDGDIIIVGA

GVAGSALAYTLAKDGRQVHVIERDLSEPDRIVGELLQPGGYLKLTELGLEDCVDEIDAQRVYGY

ALFKDGKDTRLSYPLEKFHSDVSGRSFHNGRFIQRMREKAASLPNVRLEQGTVTSLLEENGTIR

GVQYKNKSGQEMTAYAPLTIVCDGCFSNLRRSLCNPKVDVPSCFVGLILENCDLPHANHGHVIL

ADPSPILFYPISSTEIRCLVDVPGQKVPSISNGEMANYLKNVVAPQIPPQLYNSFIAAIDKGNI

RTMPNRSMPADPYPTPGALLMGDAFNMRHPLTGGGMTVALSDIVVLRDLLKPLRDLNDAPTLCK

YLEAFYTLRKPVASTINTLAGALYKVFCASPDQARKEMRQACFDYLSLGGIFSNGPVSLLSGLN

PRPLSLVLHFFAVAIYGVGRLLIPFPSPKRVWIGARLISGASAIIFPIIKAEGVRQMFFPKTVA

AYYRAPPIVRER
```

Juglans regia (JrSQE2)

(SEQ ID NO: 31)

```
MVDQYALGLILASVLGFVVLYNLMAKKNRIRVSSEARTEGVQTVITTTNGECRSIEGDVDVIIV

GAGVAGSALAHTLGKDGRKVHVIERDLSEPDRIVGELLQPGGYLKLVELGLQDSVEDIDAQRVF

GYALFKDGKNTRLSYPLEKFHSDVSGRSFHNGRFIQRMREKAASLPNIRLEQGTVTSLLEENGT

IKGVQYKTKDGKELAAHAPLTIVCDGCFSNLRRSLCNPQVDVPSSFVGLVLENCELPYANHGHV

VLADPSPILFYPISSTEVRCLVDVPGQKVPSISNGEMAKYLKTMVAPQVPPEIYDSFVAAVDRG

NIRTMPNRSMPAAPQPTPGALLMGDAFNMRHPLTGGGMTVALSDIVVLRDLLRPLRDLNDAPTL

CKYLESFYTLRKPVASTINTLAGALYKVFCASPDRARNEMRQACFDYLSLGGVFSTGPVSLLSG

LNPRPLSLVLHFFAVAVYGVGRLLVPFPSPSRMWIGARLISGASAIIFPIIKAEGVRQMFFPAT

VPAYYRAPPVNCQARSLKPDALKGL
```

Theobroma cacao (SEQ ID NO: 32)

```
MADSYVWGWILGSVMTLVALCGVVLKRRKGSGISATRTESVKCVSSINGKCRSADGSDADVIIV

GAGVAGSALAHTLGKDGRRVHVIERDLTEPDRIVGELLQPGGYLKLIELGLEDCVEEIDAQQVF

GYALFKDGKHTRLSYPLEKFHSDVSGRSFHNGRFIQRMREKSASLPNVRLEQGTVTSLLEEKGT

IRGVQYKTKDGRELTAFAPLTIVCDGCFSNLRRSLCNPKVDVPSCFVGLVLENCNLPYSNHGHV

ILADPSPILFYPISSTEVRCLVDVPGQKVPSIANGEMANYLKTIVAPQVPPEIYNSFVAAVDKG

NIRTMPNRSMPAAPYPTPGALLMGDAFNMRHPLTGGGMTVALSDIVVLRDLLRPLRDLNDAPTL

CKYLESFYTLRKPIASTINTLAGALYKVFCASPDQARKEMRQACFDYLSLGGVFSTGPISLLSG

LNPRPVSLVLHFFAVAIYGVGRLLLPFPSPKRIWIGARLISGASGIIFPIIKAEGVRQMFFPAT

VPAYYRAPPVE
```

Cucurbita moschata (SEQ ID NO: 33)

```
MMVDHCAFAWILDVVLGLVVAVTFFVAAPRRNRRGGTDSTASKDCVISTAIANGECKPDDADAE

VIIVGAGVAGSALAYTLGKDGRRVHVIERDLTEPDRIVGEFLQPGGYLKLIELGLGDCVEEIDA

QKLYGYALFKDGKNTRVSYPLGNFHSDVSGRSFHNGRFIQRMREKAASLPNVRLEQGTVTSLLE

TKGTIKGVQYKSKNGEEKTAYAPLTIVCDGCFSNLRRSLCKPMVDVPSCFVGLVLENCQLPFAN

HGHVVLGDPSPILFYPISSTEIRCLVDVPGQKVPSISNGDMEKYLKTVVAPQVPPQIHDAFIAA

IEKGNVRTMPNRSMPAAPHPTPGALLMGDAFNMRHPLTGGGMTVALSDIVVLRNLLKPLKDLND
```

ASTLCKYLESFYTLRKPVASTINTLAGALYKVFCASPDQARKEMRQACFDYLSLGGVFSNGPIS

LLSGLNPRPSSLVLHFFAVAIYGVGRLLLPFPSLKGIWIGARLIYSASGIILPIIKAEGVRQMF

FPATVPAYYRSPPVHKPIT

*Phaseolus vulgaris*
(SEQ ID NO: 34)
MLDTYVFGWIICAALSVFVIRNFVFAGKKCCASSETDASMCAENITTAAGECRSSMRDGEFDVL

IVGAGVAGSALAYTLGKDGRQVLVIERDLSEPDRIVGELLQPGGYLKLIELGLEDCVDKIDAQQ

VFGYALFKDGKHIRLSYPLEKFHSDVAGRSFHNGRFIQRMREKAASLPNVRLEQGTVTSLLEEK

GVIKGVQYKTKDSQELSVCAPFTIVCDGCFSNLRRSLCDPKVDVPSCFVGLVLENCELPCANHG

HVILGEPSPVLFYPISSTEIRCLVDVPGQKVPSISNGEMAKYLKTVIAPQVPHELHNAFIAAVD

KGSIRTMPNRSMPAAPYPTPGALLMGDAFNMRHPLTGGGMTVALSDIVVLRNLLRPLRDLNDAP

SLCKYLESFYTLRKPVASTINTLAGALYKVFCASSDPARKEMRQACFDYLSLGGQFSEGPISLL

SGLNPRPLTLVLHFFAVATYGVGRLLLPFPSPKRMWIGLRLISSASGIIMPIIKAEGVRQMFFP

ATVPAYYRNPPAA

*Hevea brasiliensis*
(SEQ ID NO: 35)
MKMADHYLLGWILASVMGLFAFYYIVYLLVKPEEDNNRRSLPQPRSDFVKTMTATNGECRSDDD

SDVDVIIVGAGVAGAALAHTLGKDGRRVHVIERDLTEPDRIVGELLQPGGYLKLIELGLEDCVE

EIDAQRVFGYALFKDGKHTQLAYPLEKFHSEVAGRSFHNGRFIQRMREKAASLPSVKLEQGTVT

SLLEEKGTIKGVLYKTKTGEELTAFAPLTIVCDGCFSNLRRSLCNPKVDVPSCFVGLVLENCRL

PYANNGHVILADPSPILFYPISSTEVRSLVDVPGQKVPSVSSGEMANYLKNVVAPQVPPEIYDS

FVAAVDKGNIRTMPNRSMPASPYPTPGALLMGDAFNMRHPLTGGGMTVALSDIVVLRDLLKPLR

DLHDAPTLCRYLESFYTLRKPVASTINTLAGALYKVFCASPDEARKEMRQACFDYLSLGGVFST

GPVSLLSGLNPRPLSLVLHFFAVAIYGVGRLLLPFPSPHRIWVGARLISGASGIIFPIIKAEGV

RQMFFPATVPAYYRAPPIKCN

*Sorghum bicolor*
(SEQ ID NO: 36)
MAAAAAAASGVGFQLIGAAAATLLAAVLVAAVLGRRRRRARPQAPLVEAKPAPEGGCAVGDGRT

DVIIVGAGVAGSALAYTLGKDGRRVHVIERDLTEPDRIVGELLQPGGYLKLIELGLEDCVEEID

AQRVLGYALFKDGRNTKLAYPLEKFHSDVAGRSFHNGRFIQRMQKAASLPNVQLEQGTVTSLL

EENGTVKGVQYKTKSGEELKAYAPLTIVCDGCFSNLRRALCSPKVDVPSCFVGLVLENCQLPHP

NHGHVILANPSPILFYPISSTEVRCLVDVPGQKVPSIASGEMANYLKTVVAPQIPPEIYDSFIA

AIDKGSIRTMPNRSMPAAPHPTPGALLMGDAFNMRHPLTGGGMTVALSDIVVLRNLLKPLHNLH

DASSLCKYLESFYTLRKPVASTINTLAGALYKVFSASPDQARNEMRQACFDYLSLGGVFSNGPI

ALLSGLNPRPLSLVAHFFAVAIYGVGRLMLPLPSPKRMWIGARLISGACGIILPIIKAEGVRQM

FFPATVPAYYRAAPMGE

*Zea mays*
(SEQ ID NO: 37)
MRKNLEEAGCAVSDGGTDVIIVGAGVAGSALAYTLGKDGRRVHVIERDLTEPDRIVGELLQPGG

YLKLIELGLQDCVEEIDAQRVLGYALFKDGRNTKLAYPLEKFHSDVAGRSFHNGRFIQRMQKA

ASLPNVQLEQGTVTSLLEENGTVKGVQYKTKSGEELKAYAPLTIVCDGCFSNLRRALCSPKVDV

PSCFVGLVLENCQLPHPNHGHVILANPSPILFYPISSTEVRCLVDVPGQKVPSIATGEMANYLK

TVVAPQIPPEIYDSFIAAIDKGSIRTMPNRSMPAAPHPTPGALLMGDAFNMRHPLTGGGMTVAL

SDIVVLRNLLKPLRNLHDASSLCKYLESFYTLRKPVASTINTLAGALYKVFSASPDQARNEMRQ

-continued

ACFDYLSLGGVFSNGPIALLSGLNPRPLSLVAHFFAVAIYGVGRLMLPLPSPKRMWIGARLISG

ACGIILPIIKAEGVRQMFFPATVPAYYRAAPTGEKA

Medicago sativa (SEQ ID NO: 38)

MDLYNIGWILSSVLSLFALYNLIFSGKRNYHDVNDKVKDSVTSTDAGDIQSEKLNGDADVIIVG

AGIAGAALAHTLGKDGRRVHIIERDLSEPDRIVGELLQPGGYLKLVELGLQDCVDNIDAQRVFG

YALFKDGKHTRLSYPLEKFHSDVSGRSFHNGRFIQRMREKAASLPNVNMEQGTVISLLEEKGTI

KGVQYKNKDGQALTAYAPLTIVCDGCFSNLRRSLCNPKVDNPSCFVGLILENCELPCANHGHVI

LGDPSPILFYPISSTEIRCLVDVPGTKVPSISNGDMTKYLKTTVAPQVPPELYDAFIAAVDKGN

IRTMPNRSMPADPRPTPGAVLMGDAFNMRHPLTGGGMTVALSDIVVLRNLLKPMRDLNDAPTLC

KYLESFYTLRKPVASTINTLAGALYKVFSASPDEARKEMRQACFDYLSLGGLFSEGPISLLSGL

NPRPLSLVLHFFAVAVFGVGRLLLPFPSPKRVWIGARLLSGASGIILPIIKAEGIRQMFFPATV

PAYYRAPPVNAF

Methylomonas lenta (SEQ ID NO: 39)

MKEEFDICIIGAGMAGATISAYLAPKGIKIALIDHCYKEKKRIVGELLQPGAVLSLEQMGLSHL

LDGFEAQTVKGYALLQGNEKTTIPYPSQHEGIGLHNGRFLQQIRASALENSSVTQIHGKALQLL

ENERNEIIGVSYRESITSQIKSIYAPLTITSDGFFSNFRAHLSNNQKTVTSYFIGLILKDCEMP

FPKHGHVFLSGPTPFICYPISDNEVRLLIDFPGEQLPRKNLLQEHLDTNVTPYIPECMRSSYAQ

AIQEGGFKVMPNHYMAAKPIVRKGAVMLGDALNMRHPLTGGGLTAVFSDIQILSAHLLAMPDFK

NTDLIHEKIEAYYRDRKRANANLNILANALYAVMSNDLLKTAVFKYLQCGGANAQESIAVLAGL

NRKHFSLIKQFCFLAVFGACNLLQQSISNIPKALK1LKDAFVIIKPLIKNELS

Bathymodiolus azoricus Endosymbiont (SEQ ID NO: 168)

MHTTSEHNDLFDICIVGAGMAGATIATYLAPRGIKIALIDRDYAEKRRIVGELLQPGAVQTLKK

MGLEHLLEGFDAQPIYGYALFNKDCEFSIEYNQDKSTNYRGVGLHNGRFLQKIREDALKQPSIT

QIHGTVSELIEDENHVVTGVKYKEKYTRELKTVNAKLTITSDGFFSSFRKDLTNNVKTVTSFFV

GIILKDCELPYPHHGHVFLSAPTPFICYPISSTESRLLIDFPGDQAPKKEAVKHHIENNVIPFL

PKEFRLCLDQALRENDYKIMPNHYMPAKPVLKKGVVLLGDALNMRHPITGGGLTAVFNDVYLLS

THLLAMPDFNDTKLIHEKVNLYYNDRYHANTNVNIMANALYGVMSNDLLKQSVFEYLRKGGDNS

GGPISLLAGLNRNPTILIKHFFSVALLCLRNLFKAHKMSLTNAFYVIKDAFCIIVPLAINELRP

SSFLKKNIHN

Methyloprofundus sediment (SEQ ID NO: 169)

MNTSPEHNDLFDICIVGVGMAGATIAAYLAPRGLKIALIDREYTEKRRIVGELLQPGAVQTLKK

MGLEHLLEGFDAQPIYGYALFNNDKEFSISYNSDDSTEYHGVGLHNGRFLQKIREDVFKNETVT

QIHGTVSELIEDKKGVVKGVTYREKHTREYKTVKAKLTVTSDGFFSNFRKDLSNNVKTVTSFFI

GLVLNDCNLPFPNHGHVFLSAPTPFICYPISSTETRLLIDYPGDKAPKKDEIREHILNKVAPFL

PEEFKECFANAMEDDDFKVMPNHYMPAKPVLKEGAVLLGDALNMRHPLTGGGLTAVFNDVYLLS

THLLAMPDFNDPKLLHEKLELYYQDRYHANTNVNIMANALYGVMSNDLLKQGVFEYLRKGGDNS

GGPITLLAGLNRNPTLLIKHFFSVAFLCICNLSGNNKMNFTNVFRVMKDAFCIIKPLAVNELRP

SSFYKKNIQL

Methylomicrobium buryatense (SEQ ID NO: 170)

MESNFDICIIGAGMAGATIAAYLAPKGINIALIDHCYKEKKRIVGELLQPGAVLSLEQLGLGHL

LDGIDAQPVEGYALLQGNEQTTIPYPSPNHGMGLHNGRFLQQIRASALQNSSVTQIQGKALSLL

-continued

ENEQNEIIGVNYRDSVSNEIKSIYAPLTITSDGFFSNFRELLSNNEKTVTSYFIGLILKDCEIP

VPKHGHVFLSGPTPFICYPISSNEVRLLIDFPGGQFPRKAFLQAHLETNVTPYIPEGMQTSYRH

ALQEDRLKVMPNHYMAAKPKIRKGAVMLGDALNMRHPLTGGGLTAVFSDIEILSGHLLAMPDFN

NNDLIYQKIEAYYRDRQYANANLNILANALYGVMSNELLKNSVFKYLQRGGVNAKESIAILAGL

NKNHYSLMKQFFFVALFGAYTLVRENITNLPKATKILSDALTIIKPLAKNELSLVGIFSDYFKR

Cucurbitadienol Synthase (CDS), Triterpene Synthase (TTP)
*Siraitia grosvenorii* CDS
(SEQ ID NO: 40)
MWRLKVGAESVGENDEKWLKSISNHLGRQVWEFCPDAGTQQQLLQVHKARKAFHDDRFHRKQSS

DLFITIQYGKEVENGGKTAGVKLKEGEEVRKEAVESSLERALSFYSSIQTSDGNWASDLGGPMF

LLPGLVIALYVTGVLNSVLSKHHRQEMCRYVYNHQNEDGGWGLHIEGPSTMFGSALNYVALRLL

GEDANAGAMPKARAWILDHGGATGITSWGKLWLSVLGVYEWSGNNPLPPEFWLFPYFLPFHPGR

MWCHCRMVYLPMSYLYGKRFVGPITPIVLSLRKELYAVPYHEIDWNKSRNTCAKEDLYYPHPKM

QDILWGSLHHVYEPLFTRWPAKRLREKALQTAMQHIHYEDENTRYICLGPVNKVLNLLCCWVED

PYSDAFKLHLQRVHDYLWVAEDGMKMQGYNGSQLWDTAFSIQAIVSTKLVDNYGPTLRKAHDFV

KSSQIQQDCPGDPNVWYRHIHKGAWPFSTRDHGWLISDCTAEGLKAALMLSKLPSETVGESLER

NRLCDAVNVLLSLQNDNGGFASYELTRSYPWLELINPAETFGDIVIDYPYVECTSATMEALTLF

KKLHPGHRTKEIDTAIVRAANFLENHQRTDGSWYGCWGVCFTYAGWFGIKGLVAAGRTYNNCLA

IRKACDFLLSKELPGGGWGESYLSCQNKVYTNLEGNRPHLVNTAWVLMALIEAGQAERDPTPLH

RAARLLINSQLENGDFPQQEIMGVFNKNCMITYAAYRNIFPIWALGEYCHRVLTE

*Momordica charantia*
(SEQ ID NO: 41)
MWRLKVGAESVGENDEKWVKSISNHLGRQVWEFCPDAGTPQQLLQIEKARKAFQDNRFHRKQTS

DLLVSIQCEKGTTNGARVPGTKLKEGEEVRKEAVKSTLERALSFYSSIQTSDGNWASDLGGPMF

LLPGLVIALCVTGALNSVLSKHHRQEMCRYLYNHQNEDGGWGLHIESPSTMFGSALNYVALRLL

GEDADGGEGRAMTKARAWILGHGGATAITSWGKLWLSVLGVYEWSGNNPLPPEFWLLPYFLPFH

PGRMWCHCRMVYLPMSYLYGKRFVGPITPVVLSLRKELYTVPYHEIDWNKSRNTCAKEDLYYPH

SKMQDILWGSIHHMYEPLFTHWPAKRLREKALKTAMQHIHYEDENTRYICLGPVNKVLNMLCCW

VEDPYSEAFKLHLQRVHDYLWVAEDGMKMQGYNGSQLWDTAFSVQAIISTKLVDNYGPTLRKAH

DYVKNSQIQQDCPGEPNVWFRHIHKGAWPFSTRDHGWLISDCTAEGLKASLMLSKLPSETVGEP

LERNRLCDAVNVLLSLQNDNGGFASYELTRSYPWLELINPAETFGDIVIDYPYVECTSATMEAL

ALFKKLHPGHRTKEIDTAIARAADFLENMQRTDGSWYGCWGVCFTYAGWFGIKGLVAAGRAYSN

CLAIRKACDFLLSKELPGGGWGESYLSCQNKVYTNLEGNRPHLVNTAWVLMALIEAGQGERDPA

PLHRAARLLINSQLENGDFPQEEIMGVFNKNCMITYAAYRNIFPIWALGEYCHRVLTE

*Cucurbita maxima*
(SEQ ID NO: 42)
MWRLKVGAESVGEKDEKWVKSVSNHLGRQVWEFCADAAADTPHQLLQIQNARNHFHHNRFHRKQ

SSDLFLAIQYEKEIAKGAKGGAVKVKEGEEVGKEAVKSTLERALGFYSAVQTSDGNWASDLGGP

MFLLPGLVIALHVTGVLNSVLSKHHRVEMCRYLYNHQNEDGGWGLHIEGTSTMFGSALNYVALR

LLGEDADGGDGGAMTKARAWILERGGATAITSWGKLWLSVLGVYEWSGNNPLPPEFWLLPYSLP

FHPGRMWCHCRMVYLPMSYLYGKRFVGPITPKVLSRQELYTIPYHEIDWNKSRNTCAKEDLYY

PHPKMQDILWGSIYHVYEPLFTRWPGKRLREKALQAAMKHIHYEDENSRYICLGPVNKVLNMLC

CWVEDPYSDAFKLHLQRVHDYLWVAEDGMRMQGYNGSQLWDTAFSIQAIVATKLVDSYAPTLRK

AHDFVKDSQIQEDCPGDPNVWFRHIHKGAWPFSTRDHGWLISDCTAEGLKASLMLSKLPSTMVG

-continued

EPLEKNRLCDAVNVLLSLQNDNGGFASYELTRSYPWLELINPAETFGDIVIDYPYVECTAATME

ALTLFKKLHPGHRTKEIDTAIGKAANFLEKMQRADGSWYGCWGVCFTYAGWFGIKGLVAAGRTY

NSCLAIRKACEFLLSKELPGGGWGESYLSCQNKVYTNLEGNKPHLVNTAWVLMALIEAGQGERD

PAPLHRAARLLMNSQLENGDFVQQEIMGVFNKNCMITYAAYRNIFPIWALGEYCHRVLTE

*Citrullus colocynthis* (CcCDS1)

(SEQ ID NO: 43)

MWRLKVGAESVGEKEEKWLKSISNHLGRQVWEFCADQPTASPNHLQQIDNARKHFRNNRFHRKQ

SSDLFLAIQNEKEIANGTKGGGIKVKEEEDVRKETVKNTVERALSFYSAIQTNDGNWASDLGGP

MFLLPGLVIALYVTGVLNSVLSKHHRQEMCRYLYNHQNEDGGWGLHIEGTSTMFGSALNYVALR

LLGEDADGGEGGAMTKARGWILDRGGATAITSWGKLWLSVLGVYEWSGNNPLPPEFWLLPYCLP

FHPGRMWCHCRMVYLPMSYLYGKRFVGPITPIVLSLRKELYTIPYHEIDWNKSRNTCAKEDLYY

PHPKMQDILWGSIYHLYEPLFTRWPGKRLREKALQMAMKHIHYEDENSRYICLGPVNKVLNMLC

CWVEDPYSDAFKFHLQRVPDYLWIAEDGMRMQGYNGSQLWDTAFSVQAIISTKLIDSFGTTLKK

AHDFVKDSQIQQDFPGDPNVWFRHIHKGAWPFSTRDHGWLISDCTAEGLKASLMLSKLPSKIVG

EPLEKSRLCDAVNVLLSLQNENGGFASYELTRSYPWLELINPAETFGDIVIDYPYVECTSATME

ALTLFKKLHPGHRTKEIDTAVAKAANFLENMQRTDGSWYGCWGVCFTYAGWFGIKGLVAAGRTY

STCVAIRKACDFLLSKELPGGGWGESYLSCQNKVYTNLEGNRPHLVNTAWVLMALIEAGQAERD

PAPLHRAARLLINSQLENGDFPQEEIMGVFNKNCMITYAAYRNIFPIWALGEYFHRVLTE

*Citrullus colocynthis* (CcCDS2)

(SEQ ID NO: 44)

MWRLKVGAESVGEKEEKWLKSISNHLGRQVWEFCAHQPTASPNHLQQIDNARNHFRNNRFHRKQ

SSDLFLAIQNEKEIANVTKGGGIKVKEEEDVRKETVKNTVERALSFYSAIQTNDGNWASDLGGP

MFLLPGLVIALYVTGVLNSVLSKHHRQEMCRYLYNHQNEDGGWGLHIEGTSTMFGSALNYVALR

LLGEDADGGEGGAMTKARSWILDRGGATAITSWGKLWLSVLGVYEWSGNNPLPPEFWLLPYCLP

FHPGRMWCHCRMVYLPMSYLYGKRFVGPITPIVLSLRKELYTIPYHEIDWNRSRNTCAKEDLYY

PHPKMQDILWGSIYHLYEPLFTRWPGKRLREKALQMAMKHIHYEDENSRYICLGPVNKVLNMLC

CWVEDPYSDAFKFHLQRVPDYLWVAEDGMRMQGYNGSQLWDTAFSVQAIISTKLIDSFGTTLKK

AHDFVKDSQIQQDCPGDPNVWFRHIHKGAWPFSTRDHGWLISDCTAEGLKASLMLSKLPSKIVG

EPLEKSRLCDAVNVLLSLQNENGGFASYELTRSYPWLELINPAETFGDIVIDYPYVECTSATME

ALTLFKKLHPGHRTKEIDIAVARAANFLENMQRTDGSWYGCWGVCFTYAGWFGIKGLVAAGRTY

NSCVAIRKACDFLLSKELPGGGWGESYLSCQNKVYTNLEGNRPHLVNTAWVLMALIEAGQAERD

PAPLHRAARLLINSQLENGDFPQEEIMGVFNKNCMITYAAYRNIFPIWALGEYFHRVLTE

*Cucurbita moschata*

(SEQ ID NO: 45)

MWRLKVGAESVGEKDEKWVKSVSNHLGRQVWEFCADAAAAATPRQLLQIQNARNHFRNRFHRK

QSSDLFLAIQYEKEIAEGGKGGAVKVKEEEEVGKEAVKSTLERALSFYSAVQTSDGNWASDLGG

PMFLLPGLVIALYVTGVLNSVLSKHHRVEMCRYLYNHQNEDGGWGLHIEGTSTMFGSALNYVAL

RLLGEDADGGDDGAMTKARAWILERGGATAITSWGKLWLSVLGVYEWSGNNPLPPEFWLLPYSL

PFHPGRMWCHCRMVYLPMSYLYGKRFVGPITPKVLSLRQELYTVPYHEIDWNKSRNTCAKEDLY

YPHPKMQDILWGSIYHVYEPLFTRWPGKRLREKALQTAMKHIHYEDENSRYICLGPVNKVLNML

CCWVEDPYSDAFKLHLQRVHDYLWVAEDGMRMQGYNGCQLWDTAFSIQAIVATKLVDSFAPTLR

KAHDFVKDSQIQEDCPGDPNVWFRHIHKGAWPFSTRDHGWLISDCTAEGLKASLMLSKLPSTMV

GEPLEKNRLCDAVNVLLSLQNDNGGFASYELTRSYPWLELINPAETFGDIVIDYPYVECTAATM

-continued

EALTLFKKLHPGHRTKEIDTAVGKAANFLEKMQRADGSWYGCWGVCFTYAGWFGIKGLVAAGRT

YNSCLAIRKACEFLLSKELPGGGWGESYLSCQNKVYTNLEGNKPHLVNTAWVLMALIEAGQGER

DPAPLHRAARLLMNSQLENGDFVQQEIMGVFNKNCMITYAAYRNIFPIWALGEYCHRVLTE

Cucumis sativus
(SEQ ID NO: 46)
MWRLKVGKESVGEKEEKWIKSISNHLGRQVWEFCAENDDDDDEAVIHVVANSSKHLLQQQRRQ

SSFENARKQFRNNRFHRKQSSDLFLTIQYEKEIARNGAKNGGNTKVKEGEDVKKEAVNNTLERA

LSFYSAIQTSDGNWASDLGGPMFLLPGLVIALYVTGVLNSVLSKHHRQEMCRYIYNHQNEDGGW

GLHIEGSSTMFGSALNYVALRLLGEDANGGECGAMTKARSWILERGGATAITSWGKLWLSVLGV

YEWSGNNPLPPEFWLLPYSLPFHPGRMWCHCRMVYLPMSYLYGKRFVGPITHMVLSLRKELYTI

PYHEIDWNRSRNTCAQEDLYYPHPKMQDILWGSIYHVYEPLFNGWPGRRLREKAMKIAMEHIHY

EDENSRYIYLGPVNKVLNMLCCWVEDPYSDAFKFHLQRIPDYLWLAEDGMRMQGYNGSQLWDTA

FSIQAILSTKLIDTFGSTLRKAHHFVKHSQIQEDCPGDPNVWFRHIHKGAWPFSTRDHGWLISD

CTAEGLKASLMLSKLPSKIVGEPLEKNRLCDAVNVLLSLQNENGGFASYELTRSYPWLELINPA

ETFGDIVIDYSYVECTSATMEALALFKKLHPGHRTKEIDAALAKAANFLENMQRTDGSWYGCWG

VCFTYAGWFGIKGLVAAGRTYNNCVAIRKACHFLLSKELPGGGWGESYLSCQNKVYTNLEGNRP

HLVNTAWVLMALIEAGQGERDPAPLHRAARLLINSQLENGDFPQQEIMGVFNKNCMITYAAYRN

IFPIWALGEYSHRVLTE

Cucumis melo
(SEQ ID NO: 47)
MWRLKVGKESVGEKEEKWIKSISNHLGRQVWEFCSGENENDDDEAIAVANNSASKFENARNHFR

NNRFHRKQSSDLFLAIQCEKEIIRNGAKNEGTTKVKEGEDVKKEAVKNTLERALSFYSAVQTSD

GNWASDLGGPMFLLPGLVIALYVTGVLNSVLSKHHRQEMCRYIYNHQNEDGGWGLHIEGSSTMF

GSALNYVALRLLGEAADGGEHGAMTKARSWILERGGATAITSWGKLWLSVLGVYEWSGNNPLPP

EFWLLPYSLPFHPGRMWCHCRMVYLPMSYLYGKRFVGPITPIVLSLRKELYTIPYHEIDWNRSR

NTCAKEDLYYPHPKMQDILWGSIYHVYEPLFSGWPGKRLREKAMKIAMEHIHYEDENSRYICLG

PVNKVLNMLCCWVEDPYSDAFKFHLQRIPDYLWLAEDGMRMQGYNGSQLWDTAFSIQAIISTKL

IDTFGPTLRKAHHFVKHSQIQEDCPGDPNVWFRHIHKGAWPFSTRDHGWLISDCTAEGLKASLM

LSKLPSKIVGEPLEKNRLCDAVNVLLSLQNENGGFASYELTRSYPWLELINPAETFGDIVIDYS

YVECTSATMEALALFKKLHPGHRTKEIDAAIAKAANFLENMQKTDGSWYGCWGVCFTYAGWFGI

KGLVAAGRTYNNCVAIRKACNFLLSKELPGGGWGESYLSCQNKVYTNLEGNKPHLVNTAWVMMA

LIEAGQGERDPAPLHRAARLLINSQLESGDFPQQEIMGVFNKNCMITYAAYRNIFPIWALGEYS

HRVLDM

Citrullus lanatus subsp. vulgaris
(SEQ ID NO: 48)
DGNWASDLGGPMFLLPGLVIALYVTGVLNSVLSKHHRQEMCRYLYNHQNEDGGWGLHIEGTSTM

FGSALNYVALRLLGEDADGGEGGAMTKARSWILDRGGATAITSWGKLWLSVLGVYEWSGNNPLP

PEFWLLPYCLPFHPGRMWCHCRMVYLPMSYLYGKRFVGPITPIVLSLRKELYTIPYHEIDWNRS

RNTCAKEDLYYPHPKMQDILWGSIYHLYEPLFTRWPGKRLREKALQMAMKHIHYEDENSRYICL

GPVNKVLNMLCCWVEDPYSDAFKFHLQRVPDYLWVAEDGMRMQGYNGSQLWDTAFSVQAIISTK

LIDSFGTTLKKAHDFVKDSQIQQDCPGDPNVWFRHIHKGAWPFSTRDHGWLISDCTAEGLKASL

MLSKLPSEIVGEPLEKSRLCDAVNVLLSLQNENGGFASYELTRSYPWLELINPAETFGDIVIDY

PYVECTSATMEALTLFKKLHPGRRTKEIDIAVARAANFLENMQRTDGSWYGCWGVCFTYAGWFG

IKGLVAAGRTYNSCVAIRKACDFLLSKELPGGGWGESYLSCQNKVYTNLEGNRPHLVNTAWVLM

-continued

ALIEAGQAERDPAPLHRAARLLINSQLENGDFPQEEIMGVFNKNCMITYAAYRNIFPIWALGEY

FHRVLTE

Theobroma cacao (SEQ ID NO: 49)

MWRLKIGKESVGDNGAWLRSSNDHVGRQVWEFCPESGTPEELSKVEMARQSFSTDRLLKKHSSD

LLMRIQYAKENQFVTNFPQVKLKEFEDVKEEATLTTLRRALNFYSTIQADDGHWPGDYGGPMFL

LPGLVITLSVTGALNAVLSKEHQYEMCRYLYNHQNRDGGWGLHIEGPSTMFGTVLNYVTLRLLG

EGPEGGQGAVEKACEWILEHGSATAITSWGKMWLSVLGAYEWSGNNPLPPEVWLCPYFLPIHPG

RMWCHCRMVYLPMSYLYGKRFVGPITPIILSLRKELYAVPYHEVDWNKARNTCAKEDLYYPHPL

VQDILWASLHYLYEPIFTRWPCKSLREKALRTVMQHIHYEDENTRYICIGPVNKVLNMLSCWVE

DPYSESFKLHLPRILDYLWIAEDGMKMQGYNGSQLWDTAFAVQAIISTGLADEYGPILRKAHDF

IKYSQVLEDCPGDLNFWYRHISKGAWPFSTVDHGWPISDCTSEGLKAVLLLSTLPSESVGEPLH

MMRLYDAVNVILSLQNVDGGFPTYELTRSYQWLELINPAETFGDIVIDYPYVECTSAAIQALIS

FKKLFPEHRMEEIENCIGRAVEFIEKIQAADGSWYGSWGVCFTYAGWFGIKGLSAAGRTYNNSS

NIRKACDFLLSKELATGGWGESYLSCQNKVYTNLEGARPHIVNTSWALLALIEAGQAERDPTPL

HRAARILINSQMEDGDFPQEEIMGVFNKNCMISYSAYRNIFPIWALGEYTCRVLRAP

Ziziphus jujube (SEQ ID NO: 50)

MWKLKIGAETVGEGGSDGWLRSVNSHLGRQVWEFHPELGTPEELRQIQDARDAFFNHRFHKQHS

SDLLMRIQFAKENPCVANPPQVKVKDTDEVTEESVTTTLRRAINFYSTIQAHDGHWAGDYGGPM

FLLPGLVITLSVTGALNAVLSKEHQCEMCRYIYNHQNEDGGWGLHIEGPSTMFGTVLNYVSLRL

LGEGAEDGLGTIENARKWILDHGGATAITSWGKMWLSVLGVYEWSGNNPLPPEVWLCPYTLPFH

PGRMWCHCRMVYLPMSYLYGKRFVGPITPTIRSLRKELYTAPYHEIDWNRARNECAKEDLYYPH

PLVQDVLWASLHYVYEPIFMRWPAKKLREKALSTVMQHIHYEDENTRYICIGPVNKVLNMLCCW

VEDPNSEAFKLHLPRISDYLWIAEDGMKMQGYNGSQLWDTAFAVQAIVSTDLAEEYGPTIRKAH

EYIKNSQVLEDCPGDLNFWYRHISKGAWPFSTADHGWPISDCTAEGLKAVLLLSQLSSETVGDS

LDVKRLFNAVNVILSLQNGDGGFATYELTR5YQWLELINPAETFGDIVIDYPYVECTSAALEAL

TLFKKSYPGHRREEVENCITNAAMFIENIQAKDGSWYGSWGVCFTYAGWFGIKGLVASGRTYEN

CPSIRKACDFLLSKELPSGGWGESYLSCQNKVYTNLKDNKPHIVNTAWAMLALIVARQAERDPM

PLHRAARILIKSQMHDGDFPQEEIMGVFNKNCMISYAAYRNIFPIWALGEYRLHVLRSL

Prunus avium (SEQ ID NO: 51)

MWKLKIGAETVGEGGYQWLKSVNNHLGRQVWEFNPELGSPEELQRIEDARKAFWDNRFERRHSS

DLLMRIQFEKENQCVTNLPQLKVKYEEEVTEEVVKTTLRRAISFYSTIQAHDGHWPGDYGGPMF

LLPGLVITLSITGALNDVLSKEHQHEMCRYLYNHQNKDGGWGLHIEGPSTMFGTALNYVTLRLF

GEGADDGEGAMELARKWILDHGGVTKITSWGKMWLSVLGTYEWSGNNPLPPEVWLCPYSLPFHP

GRMWCHCRMVYLPMSYLYGKRFVGPITPTIRSLRKELYGVPYHEVDWNQARNLCAKEDLYYPHP

MVQDILWASLHYVYEPVFTRWPAKKLRENALQTVMQHIHYEDENTRYICIGPVNKVLNMLCCWA

EDPNSDAFKLHLPRIPDYLWVAEDGMKMQGYNGSQSWDTSFAVQAIISTNLAEEFGPTLRKAHE

YIKDSQVLEDCPGDLNFWYRHISKGAWPFSTADHGWPISDCTAEGLKAVLLLSKLPTGTVGESL

DMKQLYDAVNVMLSLQNEDGGFATYELTRSYQWLELINPAETFGDIVIDYPYVECTSAAIQALT

MFRKLYPGHRREEIESCIARAAKFIEKIQATDGSWYGSWGVCFTYAGWFGIKGLAAAGRTYKDC

SSIRKACDFLLSKELPSGGWGESYLSCQNKVYTNLKDNRPHIVHTAWAMLALIGAGQAKRDPTP

-continued

LHRAARVLINSQMENGDFPQKEIMGVFNKNCMISYSAYRNIFPIWALGEYRCQVLEAL

*Brassica napus*

(SEQ ID NO: 52)
MWKLKIAEGGSPWLRTTNNHVGRQFWEFDPNLGTPEELAAVEEARKSFRENRFAKKHSSDLLMR

LQFSRESLSRPVLPQVNIKDGDDVTEKMVETTLKRGVDFYSTIQASDGHWAGDYGGPMFLLPGL

IITLSITGALNTVLSEQHKAEMRRYLHNHQNEDGGWGLHIEGPSTMFGSVLNYVTLRLLGEGPN

DGDGAMEKGRDWILNHGGATNITSWGKMWLSVLGAFEWSGNNPLPPEIWLLPYILPIHPGRMWC

HCRMVYLPMSYLYGKRFVGPITSTVLSLRKELFTVPYHEVDWNEARNLCAKEDLYYPHPLVQDI

LWASLHKIVEPVLTRWPGSNLREKALRTTLEHIHYEDENTRYICIGPVNKVLNMLCCWVEDPNS

EAFKLHLPRIHDYLWVAEDGMKMQGYNGSQLWDTSFAVQAVLATNFVEEYGPVLKKAHSYVKNS

QVSEDCPGDLSYWYRHISKGAWPFSTADHGWPISDCTAEGLKAALLLSKVPKEIVGEPVDTKRL

YDAVNVIISLQNADGGFATYELTRSYPWLELINPAETFGDIVIDYPYVECTSAAIQALIAFRKL

YPGHRKKEVDECIEKAVKFIESIQESDGSWYGSWAVCFTYGTWFGVKGLEAAGKTLKNSPTVAK

ACEFLLSKQLPSGGWGESYLSCQDKVYSNLDGNRSHVVNTAWALLSLIGAGQVEVDQKPLHRAA

RYLINAQMESGDFPQQEIMGVFNRNCMITYAAYRNIFPIWALGEYRSKVLLQQGE

*Spinacia oleracea*

(SEQ ID NO: 53)
MWKLKIAEGGSPWLRTTNNHVGRQIWEFDPNLGTPEQIREVEEARENFWKNRFEQKHSSDLLMR

MQFAQENSSNVVLPQVKVKDEDEITEETVATTLRRALSYQSTIQAHDGHWPGDYGGPMFLMPGL

VIALSVTGALNAVLSKEHQKEMCRYLYNHQNKDGGWGLHIEGHSTMFGTVLTYVTLRLLGEGVD

DGDGAMERGRKWTLEHGSATAITSWGKMWLSVLGVFEWAGNNPMPPETWLLPYILPVHPGRMWC

HCRMVYLPMSYLYGKRFVGPITPTVLSLRRELFDVPYHEIDWDRARNECAKEDLYYPHPLVQDI

LWASLHKAVEPILMRWPGKKLREKALSTVMEHIHYEDENTRYICIGPVNKVLNMLCCWVEDPNS

EAFKLHLPRIPDFLWIAEDGMKMQGYNGSQLWDTTFMVQAILATNLGEEYGGTLRKAHNFIKDS

QVREDCPGDLSYWYRHISKGAWPFSTADHGWPISDCTAEGLKAALLLSKVPSDIVGEPLEVKRL

YDSVNVLLSLQNGDGGFATYELTRSYPWLELINPAETFGDIVIDYPYVECTSAAIQALVSFKRL

YPGHRREEIENCIKKAAKFIEDIQAADGSWYGSWAVCFTYATWFGIKGLVAAGKNYDNCPAIRK

ACDFLLSKQLSNGGWGESYLSCQNKVYSNIEGNKAHVVNTGWAMLALIGAGQAKRDPMPLHRAA

KVLINSQMPNGDFPQQEIMGVFNRNCMITYAAYRNIFPTWALGEYRTQVLQK

*Trigonella foenum-graecum*

(SEQ ID NO: 54)
MWKLKVAEGGSPWLRTVNNYVGRQVWEFDPNSGSPQELDQIESVRQNFHNNRFSHKHSDDLLMR

IQLAKENPMGEVIPKVRVKDVEDVNEESVTTTLRRALNFYSTLQSRDGHWPGDYGGPMFLMPGL

VIALSITGALNAVLTDEHQKEMRRYLYNHQNKDGGWGLHIEGPSTMFGSVLCYVTLRLLGEGPN

DGEGEMEKARDWILEHGGATYITSWGKMWLSVLGVFEWSGNNPLPPEIWLLPYMLPIHPGRMWC

HCRMVYLPMSYLYGKRFVGPITPTVLSLRKELFTVPYHDIDWNQARNLCAKEDLYYPHPLVQDI

LWASLHKFVEPIFMNWPGKKLREKAVETVMEHVHYEDENTRYICIGPVNKVLNMLCCWVEDPNS

EAFKLHLPRIHDFLWIAEDGMKMQGYNGSQLWDTAFAVQAXISTNLIDEFAPTLRKAHTFIKNS

QVLEDCPGDLSKWYRHISKGAWPFSTADHGWPISDCTAEGLKAVLLLSKIGPEIVGEPLDAKGF

YDAVNVIISLQNEDGGLATYELTRSYKWLEIINPAETFGDIVIDYTYVECTSAAIQALSTFRKL

YPGHRREEIQHCIEKAAAFIEKIQASDGSWYGSWGVCFTYGTWFGVKGLIAAGKSFSNCLSIRK

ACDFLLSKQLPSGGWGESYLSCQNKVYSNLESNRSHVVNTGWAMLALIEAEQAKRDPTPLHHAA

VCLINSQMENGDFPQEEIMGVFNKNCMITYAAYRNIFPIWALGEYRRHVLQA

```
Ricinus communis
                                                       (SEQ ID NO: 55)
MWKLRIAEGSGNPWLRTTNDHIGRQVWEFDSSKIGSPEELSQIENARQNFTKNRFIHKHSSDLL

MRIQFSKENPICEVLPQVKVKESEQVTEEKVKITLRRALNYYSSIQADDGHWPGDYGGPMFLMP

GLIIALSITGALNAILSEEHKREMCRYLYNHQNRDGGWGLHIEGPSTMFGSVLCYVSLRLLGEG

PNEGEGAVERGRNWILKHGGATAITSWGKMWLSVLGAYEWSGNNPLPPEMWLLPYILPVHPGRM

WCHCRMVYLPMSYLYGKRFVGPITPTVLSLRKELYTVPYHEIDWNQARNQCAKEDLYYPHPMLQ

DVLWATLHKFVEPILMHWPGKRLREKAIQTAIEHIHYEDENTRYICIGPVNKVLNMLCCWVEDP

NSEAFKLHLPRLYDYLWLAEDGMKMQGYNGSQLWDTAFAVQAIVSTNLIEEYGPTLKKAHSFIK

KMQVLENCPGDLNFWYRHISKGAWPFSTADHGWPISDCTAEGIKALMLLSKIPSEIVGEGLNAN

RLYDAVNVVLSLQNGDGGFPTYELSRSYSWLEFINPAETFGDIVIDYPYVECTSAAIQALTSFR

KSYPEHQREEIECCIKKAAKFMEKIQISDGSWYGSWGVCFTYGTWFGIKGLVAAGKSFGNCSSI

RKACDFLLSKQCPSGGWGESYLSCQKKVYSNLEGDRSHVVNTAWAMLSLIDAGQAERDPTPLHR

AARYLINAQMENGDFPQQEIMGVFNRNCMITYAAYRDIFPIWALGEYRCRVLKAS

Epoxide Hydrolase
Siraitia grosvenorii EPH1 (SgEPH1)
                                                       (SEQ ID NO: 56)
MEKIEHSTIATNGINMHVASAGSGPAVLFLHGFPELWYSWRHQLLYLSSLGYRAIAPDLRGFGD

TDAPPSPSSYTAHHIVGDLVGLLDQLGVDQVFLVGDWGAMMAWYFCLFRPDRVKALVNLSVHFT

PRNPAISPLDGFRLMLGDDFYVCKFQEPGVAEADFGSVDTATMFKKFLTMRDPRPPIIPNGFRS

LATPEALPSWLTEEDIDYFAAKFAKTGFTGGFNYYRAIDLTWELTAPWSGSEIKVPTKFIVGDL

DLVYHFPGVKEYIHGGGFKKDVPFLEEVVVMEGAAHFINQEKADEINSLIYDFIKQF

Siraitia grosvenorii EPH2 (SgEPH2)
                                                       (SEQ ID NO: 57)
MEKIEHTTISTNGINMHVASIGSGPAVLFLHGFPELWYSWRHQLLFLSSMGYRAIAPDLRGFGD

TDAPPSPSSYTAHHIVGDLVGLLDQLGIDQVFLVGHDWGAMMAWYFCLFRPDRVKALVNLSVHF

LRRHPSIKFVDGFRALLGDDFYFCQFQEPGVAEADFGSVDVATMLKKFLTMRDPRPPMIPKEKG

FRALETPDPLPAWLTEEDIDYFAGKFRKTGFTGGFNYYRAFNLTWELTAPWSGSEIKVAAKFIV

GDLDLVYHFPGAKEYIHGGGFKKDVPLLEEVVVVDGAAHFINQERPAEISSLIYDFIKKF

Siraitia grosvenorii EPH3 (SgEPH3)
                                                       (SEQ ID NO: 58)
MDQIEHITINTNGIKMHIASVGTGPVVLLLHGFPELWYSWRHQLLYLSSVGYRAIAPDLRGYGD

TDSPASPTSYTALHIVGDLVGALDELGIEKVFLVGHDWGAIIAWYFCLFRPDRIKALVNLSVQF

IPRNPAIPFIEGFRTAFGDDFYMCRFQVPGEAEEDFASIDTAQLFKTSLCNRSSAPPCLPKEIG

FRAIPPPENLPSWLTEEDINYYAAKFKQTGFTGALNYYRAFDLTWELTAPWTGAQIQVPVKFIV

GDSDLTYHFPGAKEYIHNGGFKKDVPLLEEVVVVKDACHFINQERPQEINAHIHDFINKF

Momordica charantia
                                                       (SEQ ID NO: 59)
MEKIEHSTIAANGITIHVASVGSGPAVLLLHGFPELWYSWRHQLLFLASKGYRAIAPDLRGFGD

SDAPPSPSSYTPLHIVGDLVALLDHLGIDLVFLVGHDWGAMMAWHFCLLRPDRVKALVNLSVHF

MPRNPAMSPLDGMRLLLGDDFYVCRFQEPGAAEADFGSVDTATMMKKFLTMRDPRPPIIPNGFR

SLETPQALPPWLTEEDIDYFAAKFAKTGFTGGFNYYRAIGRTWELTAPWTGSKIKVPAKFIVGD

LDMVYHLPDAKEYIHGGGFKEDVPLLEEVVVIEGAAHFINQEKPDEISSLIYDFIKKF

Cucurbita moschata
                                                       (SEQ ID NO: 60)
MEKIEHSTIATNGINMHVASIGSGPPVLFLHGFPELWYSWRHQLLFLASKGFRAIAPDLRGFGD

SDVPPSPSSYTPFHIIGDLIGLLDHLGIEQVFLVGHDWGAMMAWYFCLFRPDRVKALVNLSVHY
```

-continued

NPRNPAISPLSRTRQFLGDDFYICKFQTPGVAEADFGSVDTATMMKKFLTIRDPSPPIIPNGFK

TLKTPETLPSWLTEEDIDYFASKFTKTGFTGGFNYYRAIEQTWELTGPWSGAKIKVPTKYVVGD

VDMVYHLPGAKQYIHGGGFKKDVPLLEEVVVMEGAAHFINQEKADEISAHIYDFIIKF

*Cucurbita maxima*

(SEQ ID NO: 61)

MENIEHTIVPTNGINMHIASIGSGPAVLFLHGFPELWYSWRHQLLFLASNGFRAIAPDLRGFGD

TDVPPSPSSYTAHHIVGDLIGLLDHLGIDRVFLVGHDWGAMMAWYFCLFRPDRVRALVNLSVHY

LHRHPSIKFVDGFRAFLGDDFYFCQFQEPGVAEADFGSVDTATMLKKFLTMRDPRPPMIPKEKG

FRALETPDPLPSWLTEEDVDYFASKFSKTGFTGGFNYYRAFDLSWELTAPWSGSQVKVPAKFIV

GDLDLVYHFPGAKEYIHGGRFKEDVPFLEEVVVIEGAAHFINQERADEISSLIYEFINKF

*Prunus persica*

(SEQ ID NO: 62)

MEKIEHTTVSTNGINMHIASIGTGPVVLFLHGFPELWYSWRHQLLSLSSLGYRCIAPDLRGFGD

TDAPPSPASYSALHIVGDLIGLLDHLGIDQVFLVGHDWGAVIAWWFCLFRPDRVKALVNMSVAF

SPRNPKRKPVDGFRALFGDDYYICRFQEPGEIEKEFAGYDTTSIMKKFLTGRSPKPPCLPKELG

LRAWKTPETLPPWLSEEDLNYFASKFSKTGFVGGLNYYRALNLTWELTGPWTGLQVKVPVKFIV

GDLDITYHIPGVKNYIHNGGFKRDVPFLQEVVVIEDGAHFINQERPDEISRHVYDFIQKF

*Morus notabilis*

(SEQ ID NO: 63)

MEKIEHSTVHTNGINMHVASVGTGPAILFLHGFPELWYSWRHQMISLSSLGYRCIAPDLRGYGD

TDAPPSPTSYTSLHIVGDLVGLIDHLVIEKLFLVGHDWGAMIAWYFCLFRPDRIKALVNLSVPF

FPRNPKINFVDGFRAELGDDFYICRFQEPGESEADFSSDTVAVFRRILANRDPKPPLIPKEIGF

RGVYEDPVALPSWLTEDDINHFANKFNETGFTGGLNYYRALNLTWELTAAWTGARVQVPTKFIM

GDLDLVYYFPGMKEYILNGGFKRDVPLLQELVIIEGAAHFINQEKPDEISSHIHHFIQKF

*Ricinus communis*

(SEQ ID NO: 64)

MEKIEHTTVATNGINMHVAAIGTGPEILFLHGFPELWYSWRHQLLSLSSRGYRCIAPDLRGYGD

TDAPESLTGYTALHIVGDLIGLLDSMGIEQVFLVGHDWGAMMAWYLCMFRPDRIKALVNTSVAY

MSRNPQLKSLELFRTVYGDDYYVCRFQEPGGAEEDFAQVDTAKLIRSVFTSRDPNPPIVPKEIG

FRSLPDPPSLPSWLSEEDVNYYADKFNKKGFTGGLNYYRNIDQNWELTAPWDGLQIKVPVKFVI

GDLDLTYHFPGIKDYIHNGGFKQVVPLLQEVVVMEGVAHFINQEKPEEISEHIYDFIKKF

*Citrus unshiu*

(SEQ ID NO: 65)

MEKIEHTTVGTNGINMHVASIGTGPVVLFIHGFPELWYSWRNQLLYLSSRGYRAIAPDLRGYGD

TDAPPSVTSYTALHLVGDLIGLLDKLGIHQVFLVGHDWGALIAWYFCLFRPDRVKALVNMSVPF

PPRNPAVRPLNNFRAVYGDDYYICRFQEPGEIEEEFAQIDTARLMKKFLCLRIAKPLCIPKDTG

LSTVPDPSALPSWLSEEDVNYYASKFNQKGFTGPVNYYRCSDLNWELMAPWTGVQLEVPVKFIV

GDQDLVYNNKGMKEYIHNGGFKKYVPYLQEVVVMEGVAHFINQEKAEEVGAHIYEFIKKF

*Hevea brasiliensis*

(SEQ ID NO: 66)

MEKIEHITVFTNGINMHIASIGTGPEILFLHGFPELWYSWRHQLLSLSSLGYRCIAPDLRGYGD

TDAPQSVNQYTVLHIVGDLVGLLDSLGIQQVFLVGHDWGAFIAWYFCIFRPDRIKALVNTSVAF

MPRNPQVKPLDGLRSMFGDDYYICQFQKPGKAEEDFAQVNTAKLIKLLFTSRDPRPPHFLKEVG

LKALQDPPSQQSWLTEEDVNFYAAKFNQKGFRGGLNYYQNINMNWELAAAWTGVQIKVPVKFII

GDLDLTYHFPGIKEYIHNGGFKKDVPLLQDVVVMEGVAHFLNQEKPEEVSKHIYDFIKKF

-continued

*Handroanthus impetiginosus*
(SEQ ID NO: 67)
MDKIQHKIIQTNGININHVAEIGDGPAVLFLHGFPELWYSWRHQMLFLSSRGYRAIAPDLRGYGD

SDAPPCATSYTAFHIIGDLVGLLDAMGLDRVFLVGHDWGAVMAWYFCLLRPDRIKALVNLSVVF

QPRNPKRKPVESMRAKLGDDYYICRFQEPGEAEEEFARVDTARLIKKLLTTRNPAPPRLPKEVG

FGCLPHKPITMPSWLSEEDVQYYAAKFNQKGFTGGLNYYRAMDLSWELAAPWTGVQIKVPVKFI

VGDLDITYNTPGVKEYIHKGRFKQHVPFLQELVILEGVAHFLNQEKPDEINQHIYDFIHKF

*Camelina sativa*
(SEQ ID NO: 68)
MEKIEHTTVSTNGINMHVASIGSGPVILFLHGFPDLWYSWRHQLLSFAALGYRAIAPDLRGYGD

SDAPPSPESYTILHIVGDLVGLLDSLGVDRVFLVGHDWGAIVAWWLCMIRPDRVKALVNTSVVF

NPRNPSVKPVDKFRDLFGDDYYVCRFQETGEIEEDFAQVDTKKLITRFFVSRNPRPPCIPKSVG

FRGLPDPPSLPAWLTEQDVSFYGDKFSQKGFTGGLNYYRAMNLSWELTAPWAGLQIKVPVKFIV

GDLDITYNIPGTKEYIHGGGLKKHVPFLQEVVVMEGVGHFLQQEKPDEVTDHIYGFFEKFRTRE

TSSL

*Coffea canephora*
(SEQ ID NO: 69)
MDKIQHRQVPVNGINLHVAEIGDGPAILFLHGFPELWYSWRHQLLSLSAKGYRALAPDLRGYGD

SDAPPSPSNYTALHIVGDLVGLLDSLGLDRVFLVGHDWGAVMAWYFCLLRPDRIKALVNMSVVF

TPRNPKRKPLEAMRARFGDDYYICRFQEPGEAEEEFARVDTARIIKKFLTSRRPGPLCVPKEVG

FGGSPHNPIQLPSWLSEDDVNYFASKFSQKGFTGGLNYYRAMDLNWELTAPWTGLQIKVPVKFI

VGDLDVTFTTPGVKEYIQKGGFKRDVPFLQELVVMEGVAHFVNQEKPEEVSAHIYDFIQKF

*Punica granatum*
(SEQ ID NO: 70)
MEKIQHTTVRTNGINMHVATAGSGPDSILFVHGFPELWYTWRHQMVSLAALGYRTIAPDLRGYG

DTDAPPSHESYTAFHIVGDLVGLLDSMGIEKVFLVGHDWGAAIAWYFCLFRPDRIKALVNMSVV

FHPRNPNRKPVDGLRAILGDDYYICRFQAPGEIEEDFARADTANIIKFFLVSRNPRPPQIPKEG

FSCLANSRQMDLPSWLSEEDINYYASKFSEKGFTGGLNYYRVMNLNWELTAPFTGLQIKVPAKF

MVGDLDITYNTPGTKEFIHNGGLKKHVPFLQEVVVMEGVAHFINQEKPEEVTAHIYDFIKKF

*Arabidopsis lyrata* subsp. *lyrata*
(SEQ ID NO: 71)
MEKIEHTTVSTNGINMHVASIGSGPVILFLHGFPDLWYSWRHQLLSFAALGYRAIAPDLRGYGD

SDAPPSRESYTILHIVGDLVGLLNSLGVDRVFLVGHDWGAIVAWWLCMIRPDRVNALVNTSVVF

NPRNPSVKPVDAFRALFGDDYYICRFQEPGEIEEDFAQVDTKKLITRFFISRNPRPPCIPKSVG

FRGLPDPPSLPAWLTEEDVSFYGDKFSQKGFTGGLNYYRALNLSWELTAPWAGLQIKVPVKFIV

GDLDITYNIPGTKEYIHEGGLKKHVPFLQEVVVLEGVGHFLHQEKPDEITDHIYGFFKKFRTRE

TASL

*Rhinolophus sinicus*
(SEQ ID NO: 72)
MDKIEHTTVSTNGINMHVASIGSGPVILFLHGFPDLWYSWRHQLLSFAGLGYRAIAPDLRGYGD

SDSPPSHESYTILHIVGDLVGLLDSLGVDRVFLVGHDWGAVVAWWLCMIRPDRVNALVNTSVVF

NPRNPSVKPVDAFKALFGEDYYVCRFQEPGEIEEDFAQVDTKKLINRFFTSRNPRPPCIPKTLG

FRGLPDPPALPAWLTEQDVSFYADKFSQKGFTGGLNYYRAMNLSWELTAPWAGLQIKVPVKFIV

GDLDITYNIPGTKEYIHEGGLKKHVPFLQEVVVMEGVGHFLHQEKPDEVTDHIYGFFKKF

Cytochrome P450
*Siraitia grosvenorii* CYP87D18
(SEQ ID NO: 73)
MWTVVLGLATLFVAYYIHWINKWRDSKFNGVLPPGTMGLPLIGETIQLSRPSDSLDVHPFIQKK -continued

VERYGPIFKTCLAGRPVVVSADAEFNNYIMLQEGRAVEMWYLDTLSKFFGLDTEWLKALGLIHK

YIRSITLNHFGAEALRERFLPFIEASSMEALHSWSTQPSVEVKNASALMVFRTSVNKMFGEDAK

KLSGNIPGKFTKLLGGFLSLPLNFPGTTYHKCLKDMKEIQKKLREVVDDRLANVGPDVEDFLGQ

AFKDKESEKFISEEFIIQLLFSISFASFESISTTLTLILKLLDEHPEVVKELEVEHEAIRKARA

DPDGPITWEEYKSMTFTLQVINETLRLGSVTPALLRKTVKDLQVKGKIIPEGWTIMLVTASRHR

DPKVYKDPHIFNPWRWKDLDSITIQKNFMPFGGGLRHCAGAEYSKVYLCTFLHILCTKYRWTKL

GGGTIARAHILSFEDGLHVKFTPKE

Cucumis melo
(SEQ ID NO: 74)
MWTILLGLATLAIAYYIHWVNKWKDSKFNGVLPPGTMGLPLIGETIQLSRPSDSLDVHPFIQSK

VKRYGPIFKTCLAGRPVVVSTDAEFNHYIMLQEGRAVEMWYLDTLSKFFGLDTEWLKALGLIHK

YIRSITLNHFGAESLRERFLPRIEESARETLHYWSTQPSVEVKESAAAMVFRTSIVKMFSEDSS

KLLTAGLTKKFTGLLGGFLTLPLNVPGTTYHKCIKDMKEIQKKLKDILEERLAKGVSIDEDFLG

QAIKDKESQQFISEEFIIQLLFSISFASFESISTTLTLILNFLADHPDVAKELEAEHEAIRKAR

ADPDGPITWEEYKSMNFTLNVICETLRLGSVTPALLRKTTKEIQIKGYTIPEGWTVMLVTASRH

RDPEVYKDPDTFNPWRWKELDSITIQRNFMPFGGGLRHCAGAEYSKVYLCTFLHILFTKYRWRK

LKGGKIARAHILRFEDGLYVNFTPKE

Cucurbita maxima
(SEQ ID NO: 75)
MWTIVVGLATLAVAYYIHWINKWKDSKFNGVLPPGTMGLPLIGETLQLSRPSDSLDVHPFIKKK

VKRYGSIFKTCLAGRPVVVSTDAEFNNYIMLQEGRAVEMWYLDTLSKFFGLDTEWLKALGFIHK

YIRSITLNHFGAESLRERFLPRIEESAKETLCYWATQPSVEVKDSAAVMVFRTSMVKMVSKDSS

KLLTGGLTKKFTGLLGGFLTLPINVPGTTYNKCMKDMKEIQKKLREILEGRLASGAGSDEDFLG

QAVKDKGSQKFISDDFIIQLLFSISFASFESISTTLTLILNYLADHPDVVKELEAEHEAIRNAR

ADPDGPITWEEYKSMTFTLHVIFETLRLGSVTPALLRKTTKELQINGYTIPEGWTVMLVTASRH

RDPAVYKDPHTFNPWRWKELDSITIQKNFMPFGGGLRHCAGAEYSKVYLCTFLHILFTKYRWTK

LKGGKVARAHILSFEDGLHMKFTPKE

Cucumis sativus
(SEQ ID NO: 76)
MWTILLGLATLAIAYYIHWVNKWKDSKFNGVLPPGTMGLPLIGETIQLSRPSDSLDVHPFIQRK

VKRYGPIFKTCLAGRPVVVSTDAEFNHYIMLQEGRAVEMWYLDTLSKFFGLDTEWLKALGLIHK

YIRSITLNHFGAESLRERFLPRIEESARETLHYWSTQTSVEVKESAAAMVFRTSIVKMFSEDSS

KLLTEGLTKKFTGLLGGFLTLPLNLPGTTYHKCIKDMKQIQKKLKDILEERLAKGVKIDEDFLG

QAIKDKESQQFISEEFIIQLLFSISFASFESISTTLTLILNFLADHPDVVKELEAEHEAIRKAR

ADPDGPITWEEYKSMNFTLNVICETLRLGSVTPALLRKTTKEIQIKGYTIPEGWTVMLVTASRH

RDPEVYKDPDTFNPWRWKELDSITIQKNFMPFGGGLRHCAGAEYSKVYLCTFLHILFTKYRWRK

LKGGKIARAHILRFEDGLYVNFTPKE

Cucurbita moschata
(SEQ ID NO: 77)
MWAIVVGLATLAVAYYIHWINKWKDSKFNGVLPPGTMGLPLVGETLQLARPSDSLDVHPFIKKK

VKRYGSIFKTCLAGRPVVVSTDAEFNNYIMLQEGRAVEMWYLDTLSKFFGLDTEWLKALGFIHK

YIRSITLNHFGAESLRERFLPRIEESAKETLRYWATQPSVEVKDSAAVMVFRTSMVKMVSEDSS

KLLTGGLTKKFTGLLGGFLTLPINVPGTTYNKCMKDMKEIQKKLREILEGRLASGAGSDEDFLG

QAIKDKGSQQFISDDFIIQLLFSISFASFESISTTLTLVLNYLADHPDVVKELEAEHEAIRNAR

-continued

ADPDGPITWEEYKSMTFTLHVIFETLRLGSVTPALLRKTTKELQINGYTIPEGWTVMLVTASRH

RDPAVYKDPHTFNPWRWKELDSITIQKNFMPFGGGLRHCAGAEYSKVYLCTFLHILFTKYRWTK

LKGGKVARAHILSFEDGLHVKFTPKE

*Prunus avium*
(SEQ ID NO: 78)
MWTLVGLSLVALLVIYFTHWIIKWRNPKCNGVLPPGSMGLPLIGETLNLIIPSYSLDLHPFIKK

RLQRYGPIFRTSLAGRPVVVTADPEFNNYIFQQEGRMVELWYLDTFSKIFVHEGDSKTNAIGMV

HKYVRSIFLNHFGAERLKEKLLPQIEEFVNKSLCAWSSKASVEVKHAGSVMVFNFSAKQMISYD

AEKSSDDLSEKYTKIIDGLMSFPLNIPGTAYYNCSKHQKNVTTMLRDMLKERRISPETRRGDFL

DQLSIDMEKEKFLSEDFSVQLVFGGLFATFESISAVIALAFSLLADHPSVVEELTAEHEAILKN

RENPNSSITWDEYKSMTFTLQVINEILRLGNVAPGLLRRALKDIPVKGFTIPEGWTIMVVTSAL

QLSPNTFEDPLEFNPWRWKDLDSYAVSKNFMPFGGGMRQCAGAEYSRVFLATFLHVLVTKYRWT

TIKAARIARNPILGFGDGIHIKFEEKKT

*Populus trichocarpa*
(SEQ ID NO: 79)
MWAIGLVVVALVVIYYTHMIFKWRSPKIEGVLPPGSMGWPLIGETLQFISPGKSLDLHPFVKKR

MEKYGPIFKTSLVGRPIIVSTDYEMNKYILQHEGTLVELWYLDSFAKFFALEGETRVNAIGTVH

KYLRSITLNHFGVESLKESLLPKIEDMLHTNLAKWASQGPVDVKQVISVMVFNFTANKIFGYDA

ENSKEKLSENYTKILNSFISLPLNIPGTSFHKCMQDREKMLKMLKDTLMERLNDPSKRRGDFLD

QAIDDMKTEKFLTEDFIPQLMFGILFASFESMSTTLTLTFKFLTENPRVVEELRAEHEAIVKKR

ENPNSRLTWEEYRSMTFTQMVVNETLRISNIPPGLFRKALKDFQVKGYTVPAGWTVMLVTPATQ

LNPDTFKDPVTFNPWRQELDQVTISKNFMPFGGGTRQCAGAEYSKLVLSTFLHILVTNYSFTK

IRGGDVSRTPIISFGDGIHIKFTARA

*Prunus persica*
(SEQ ID NO: 80)
MWTLVGLSLVGLLVIYFTHWIIKWRNPKCNGVLPPGSMGLPFIGETLNLIIPSYSLDLHPFIKK

RLQRYGPIFRTSLAGRQVVVTADPEFNNYLFQQEGRMVELWYLDTFSKIFVHEGESKTNAVGMV

HKYVRSIFLNHFGAERLKEKLLPQIEEFVNKSLCAWSSKASVEVKHAGSVMVFNFSAKQMISYD

AEKSSDDLSEKYTKIIDGLMSFPLNIPGTAYYNCLKHQKNVTTMLRDMLKERQISPETRRGDFL

DQISIDMEKEKFLSEDFSVQLVFGGLFATFESISAVLALAFSLLAEHPSVVEELTAEHEAILKN

RENLNSSLTWDEYKSMTFTLQVINEILRLGNVAPGLLRRALKDIPVKGFTIPEGWTIMVVTSAL

QLSPNTFEDPLEFNPWRWKDLDSYAVSKNFMPFGGGMRQCAGAEYSRVFLATFLHVLVTKYRWT

TIKAARIARNPILGFGDGIHIKFEEKKT

*Populus euphratica*
(SEQ ID NO: 81)
MWTFVLCVVAVLVVYYTHWINKWRNPTCNGVLPPGSMGLPIIGETLELIIPSYSLDLHPFIKKR

IQRYGPIFRTNILGRPAVVSADPEINSYIFQNEGKLVEMWYMDTFSKLFAQSGESRTNAFGIIH

KYARSLTLTHFGSESLKERLLPQVENIVSKSLQMWSSDASVDVKPAVSIMVCDFTAKQLFGYDA

ENSSDKISEKFTKVIDAFMSLPLNIPGTTYHKCLKDKDSTLSILRNTLKERMNSPAESRGGDFL

DQIIADMDKEKFLTEDFTVNLIFGILFASFESISAALTLSLKLIGDHPSVLEELTVEHEAILKN

RENPDSPLTWAEYNSMTFSLQVINETLRLGNVAPGLLRRALQDMQVKGYTIPAGWVIMVVNSAL

HLNPATFKDPLEFNPWRWKDFDSYAVSKNLMPFGGGRRQCAGSEFTKLFMAIFLHKLVTKYRWN

IIKQGNIGRNPILGFGDGIHISFSPKDI

*Juglans regia*
(SEQ ID NO: 82)
MWKVGLCVVGVIVVWFTRWINKWRNPKCNGILPPGSMGPPLIGESLQLIIPSYSLDLHPFIKKR -continued

```
VQRYGPIFRTSVVGQPMVVSTDVEFNHYLAKQEGRLVHFWYLDSFAEIFNLEDENAISAVGLIH

KYGRSIVLNHFGTDSLKKTLLSQIEEIVNKTLQTWSSLPSVEVKHAASVMAFDLTAKQCFGYDV

ENSAVKMSEKFLYTLDSLISFPFNIPGTVYHKCLKDKKEVLNMLRNIVKERMNSPEKYRGDFLD

QITADMNKESFLTQDFIVYLLYGLLFASFESISASLSLTLKLLAEHPAVLQQLTAEHEAILKNR

DNPNSSLTWDEYKSMTFTFQVINEALRLGNVAPGLLRRALKDIEFKGYTIPAGWTIMLANSAIQ

LNPNTYEDPLAFNPWRWQDLDPQIVSKNFMPFGGGIRQCAGAEYSKTFLATFLHVLVTKYRWTK

VKGGKMARNPILWFADGIHINFALKHN
```

*Pyrus x bretschneideri*
(SEQ ID NO: 83)
```
MWDVVGLSFVALLVIYLTYWITQWKNPKCNGVLPPGSMGLPLIGETLNLLIPSYSLDLHPFIRK

RLERYGPIFRTSLAGKPVLVSADPEFNNYVLKQEGRMVEFWYLDTFSKIFMQEGGNGTNQIGVI

HKYARSIFLNHFGAECIKEKLLTQIEGSINKHLRAWSNQESVEVKKAGSIMALNFCAEHMIGYD

AETATENLGEIYHRVFQGLISFPLNVPGTAYHNCLKIHKKATTMLRAMLRERRSSPEKRRGDFL

DQIIDDLDQEKFLSEDFCIHLIFGGLFAIFESISTVLTLFFSLLADHPAVLQELTAEHEALLKN

REDPNSALTWDEYKSMTFTLQVINETLRLVNTAPGLLRRALKDIPVKGYTIPAGWTILLVTPAL

HLTSNTFKDHLEFNPWRWKDLDSLVISKNFMPFGSGLRQCAGAEFSRAYLSTFLHVLVTKYRWT

TIKGARISRRPMLTFGDGAHIKFSEKKN
```

*Morus notabilis*
(SEQ ID NO: 84)
```
MWNTICLSVVGLVVIWISNWIRRWRNPKCNGVLPPGSMGFPLIGETLPLIIPTYSLDLHPFIKN

RLQRYGSIFRTSIVGRPVVISADPEFNNFLQQEGSLVELYYLDTFSKIFVHEGVSRTNEFGVV

HKYIRSIFLNHFGAERLKEKLLPEIEQMVNKTLSAWSTQASVEVKHAASVLVLDFSAKQIISYD

AKKSSESLSETYTRIIQGFMSFPLNIPGTAYNQCVKDQKKIIAMLRDMLKERRASPETNRGDFL

DQISKDMDKEKFLSEDFVVQLIFGGLFATFESVSAVLALGFHLLSEHPSVLEEMIAEHETILKN

REHPNSLLAWGEYKSMTFTLQVINETLRLGNVAPGLLRKALKDIRVKGFTIPKGWAIMMVTSAL

QLSPSTFKNPLEFNPWRWKDLDSLVISKNFMPFGRGMRQCAGAEYSRAFMATFFHVLLTKYRWT

TIKVGNVSRNPILRFGNGIHIKFSKKN
```

*Jatropha curcas* (JcP450.1)
(SEQ ID NO: 85)
```
MWIIGLCFASLLVIYCTHFFYKWRNPKCKGVLPPGSMGLPIIGETLQLIIPSYSLDHHPFIQKR

IQRYGPIFRTNLVGRPVIVSADPEVNQYIFQQEGNSVEMWYLDAYAKIFQLDGESRLSAVGRVH

KYIRSITLNNFGIENLKENLLPQIQDLVNQSLQKWSNKASVDVKQAASVMVFNLTAKQMFSYGV

EKNSSEEMTEKFTGIFNSLMSLPLNIPGTTYHKCLKDREAMLKMLRDTLKQRLSSPDTHRGDFL

DQAIDDMDTEKFLTGDCIPQLIFGILLAGFETTATTLTLAFKFLAEHPLVLEELTAEHEKILSK

RENLESPLTWDEYKSMTFTHHVINETLRLANFLPGLLRKALKDIQVKNYTIPAGWTIMVVKSAM

QLNPEIYKDPLAFNPWRWKDLDSYTVSKNFMPFGGGSRQCAGADYSKLFMTIFLHVLVTKYRWR

KIKGGDIARNPILGFGDGLHIEVSAKN
```

*Hevea brasiliensis*
(SEQ ID NO: 86)
```
MLTVVLLLVGFFIIYYTYWISKWRNPNCNGVLPPGSMGFPLIGETLQLLIPSYSLDLHPFIKKR

IHRYGPIFRSNLAGRPVIVSADPEFNYYILSQEGRSVEIWYLDTFSKLFRQQGESRTNVAGYVH

KYLRGAFLSQIGSENLREKLLLHIQDMVNRTLCSWSNQESVEVKHSASLAVCDFTAKVLFGYDA

EKSPDNLSETFTRFVEGLISFPLNIPRTAYRQCLQDRQKALSILKNVLTDRRNSVENYRGDVLD

LLLNDMGKEKFLTEDFICLIMLGGLFASFESISTITTLLLKLFSAHPEVVQELEAEHEKILVSR
```

-continued

HGSDSLSITWDEYKSMTFTHQVINETLRLGNVAPGLLRRAIKDVQFKGYTIPSGWTIMMVTSAQ

QVNPEVYKDPLVFNPWRWKDFDSITVSKNFTPFGGGTRQCVGAEYSRLTLSLFIHLLVTKYRWT

KIKEGEIRRAPMLGFGDGIHFKFSEKE

*Jatropha curcas* (JcP450.2)
(SEQ ID NO: 87)
MKRAIYICLARITKQGLSLIEMLMTELLFGAFFIIFLTYWINRWRNPKCNGVLPPGSMGLPLLG

ETLQLLIPRYSLDLHPFIRKRIQRYGPIFRSNVAGRPIVFTADPELNHYIFIQERRLVELWYMD

TFSNLFVLDGESRPTGATGYIHKYMRGLFLTHFGAERLKDKLLHQIQELIHTTLQSWCKQPTIE

VKHAASAVICDFSAKFLFGYEAEKSPFNMSERFAKFAESLVSFPLNIPGTAYHQSLEDREKVMK

LLKNVLRERRNSTKKSEEDVLKQILDDMEKENFITDDFIIQILFGALFAISESIPMTIALLVKF

LSAQPSVVEELTAEHEEILKNKKEKGLDSSITWEDYKSMTFTLQVINETLRIANVAPGLLRRTL

RDIHYKGYTIPAGWTIMVLTSSRHMNPEIYKDPVEFNPWRWKDLDSQTISKNFTPFGGGTRQCA

GAEYSRAFISMFLHVLVTKYRWKNVKEGKICRGPILRIEDGIHIKLYEKH

*Chenopodium quinoa*
(SEQ ID NO: 88)
MWPTMGLYVATIVAICFILLELKRRNSREKQVVLPPGSKGFPLIGETLQLLVPSYSLDLPSFIR

TRIQRYGPIFKTRLVGRPVVMSADPGFNRYIVQQEGKSVEMWYLDTFSKLFAQDGEARTTAAGL

VHKYLRNLTLSHFGSESLRVNLLPHLESLVRNTLLGWSSKDTIDVKESALTMTIEFVAKQLFGY

DSDKSKEKIGEKFGNISQGLFSLPLNIPGTTYHSCLKSQREVMDMMRTALKDRLTTPESYRGDF

LDHALKDLSTEKFLSEEFILQIMFGLLFASSESTSMTLTLVLKLLSENPHVLKELEAEHERIIK

NKESPDSPLTWAEVKSMTFTLQVINESLRLGNVSLGILRRTLKDIEINGYTIPAGWTIMLVTSA

CQYNSDIYKDPLTFNPWRWKEMQPDVIAKNFMPFGGGTRQCAGAEFAKVLMTIFLHNLVTNYRW

EKIKGGEIVRTPILGFRNALRVKLTKKN

*Spinacia oleracea*
(SEQ ID NO: 89)
MVLLPGSKGFPFIGETLQLLLPSYSLDLPSFIRTRIQRYGPIFQTRLVGRPVVVSADPGFNRYI

VQQEGKMVEMWYLDTFSKIFAQQGEGRTNAAGLVHKYLRNITFTHFGSQTLRDKLLPHLEILVR

KTLHGWTSQESIDVKEAALTMTIEFVAKQLFGYDSDKSKERIGDKFANISQGLLSFPLNIPGTT

YHSCLKSQREVMDMMRKTLKERLASPDTCQGDFLDHALKDLNTDKFLTEDFILQIMFGLLFASS

ESTSITLTLILKFLSENPHVLEELEVEHERILKNRESPDSPLTWAEVKSMTFTLQVINESLRLG

NVSLGLLRRTLKDIEINGYTIPAGWTIMLVTSACQYNSDVYKDPLTFNPWRWKEMQPDVIAKNF

MPFGGGTRQCAGAEFAKVLMTIFLHVLVTTYRWEKIGGEIIRTPILGFRNGLHVKLIKKARLS

*Manihot esculenta*
(SEQ ID NO: 90)
MEMWSVWLYIISLIIIIATHWIYRWRNPKCNGKLPPGSMGIPFIGETIQFLIPSKSLDVPNFIK

KRMNKYGPLFRTNLVGRPVIVSSDPDFNYYLLQREGKLVERWYMDSFSKLLHHDVTQIIIKHGS

IHKYLRNLVLGHFGPEPLKDKLLPQLESAISQRLQDWSKQPSIEAKSASSAHIFDFTAKILFSY

EPEKSGENIGEIFSNFLQGLMSIPLNIPGTAFHRCLKNQKRAIQMITEILKERRSNPEIHKGDF

LDQIVEDMKKDSFWTEEFAIYMMFGLLLASFETISSTLALAIIFLTDNPPVVQKLTEEHEAILK

ARENRDSGLSWKEYKSLSYTHQVVNESLRLASVAPGILRRAITDIQVDGYTIPKGWTIMVVPAA

VQLNPNTFEDPLVFNPSRWEDMGAVAMAKNFIAFGGGSRSCAGAEFSRVLMSVFVHVFVTNYRW

TKIKGGDMVRSPALGFGNGFHIRVSEKQL

*Olea europaea* var. *sylvestris*
(SEQ ID NO: 91)
MAALDLSTVGYLIVGLLTVYITHWIYKWRNPKCNGVLPPGSMGLPLIGETIQLVIPNASLDLPP

FIKKRMKRYGPIFRTNVAGRPVIITADPEFNHFLLRQDGKLVDTWSMDTFAEVFDQASQSSRKY

-continued

TRHLTLNHFGVEALREKLLPQMEDMVRTTLSNWSSQESVEVKSASVTMAIDYAARQIYSGNLEN

APLKISDLFRDLVDGLMSFPINIPGTAHHRCLQTHKKVREMMKDIVKTRLEEPERQYGDMLDHM

IEDMKKESFLDEDFIVQLMFGLFFVTSDSISTTLALAFKLLAEHPLVLEELTAEHEAILKKREK

SESHLTWNDYKSMTFTLQVINEVLRLGNIAPGFFRRALQDIPVNGYTIPSGWVIMIATAGLHLN

SNQFEDPLKFNPWRWKVCKVSSVIAKCFMPFGSGMKQCAGAEYSRVLLATFIHVLTTKYRWAIV

KGGKIVRSPIIRFPDGFHYKIIEKTN

Cytochrome P450 Reductase
*Stevia rebaudiana* (SrCPR1)
(SEQ ID NO: 92)
MAQSDSVKVSPFDLVSAAMNGKAMEKLNASESEDPTTLPALKMLVENRELLTLFTTSFAVLIGC

LVFLMWRRSSSKKLVQDPVPQVIVVKKKEKESEVDDGKKKVSIFYGTQTGTAEGFAKALVEEAK

VRYEKTSFKVIDLDDYAADDDEYEEKLKKESLAFFFLATYGDGEPTDNAANFYKWFTEGDDKGE

WLKKLQYGVFGLGNRQYEHFNKIAIVVDDKLTEMGAKRLVPVGLGDDDQCIEDDFTAWKELVWP

ELDQLLRDEDDTSVTTPYTAAVLEYRVVYHDKPADSYAEDQTHTNGHVVHDAQHPSRSNVAFKK

ELHTSQSDRSCTHLEFDISHTGLSYETGDHVGVYSENLSEVVDEALKLLGLSPDTYFSVHADKE

DGTPIGGASLPPPFPPCTLRDALTRYADVLSSPKKVALLALAAHASDPSEADRLKFLASPAGKD

EYAQWIVANQRSLLEVMQSFPSAKPPLGVFFAAVAPRLQPRYYSISSSPKMSPNRIHVTCALVY

ETTPAGRIHRGLCSTWMKNAVPLTESPDCSQASIFVRTSNFRLPVDPKVPVIMIGPGTGLAPFR

GFLQERLALKESGTELGSSIFFFGCRNRKVDFIYEDELNNFVETGALSELIVAFSREGTAKEYV

QHKMSQKASDIWKLLSEGAYLYVCGDAKGMAKDVHRTLHTIVQEQGSLDSSKAELYVKNLQMSG

RYLRDVW

*Arabidopsis thaliana* CPR1 (AtCPR1)
(SEQ ID NO: 93)
MATSALYASDLFKQLKSIMGTDSLSDDVVLVIATTSLALVAGFVVLLWKKTTADRSGELKPLMI

PKSLMAKDEDDDLDLGSGKTRVSIFFGTQTGTAEGFAKALSEEIKARYEKAAVKVIDLDDYAAD

DDQYEEKLKKETLAFFCVATYGDGEPTDNAARFYKWFTEENERDIKLQQLAYGVFALGNRQYEH

FNKIGIVLDEELCKKGAKRLIEVGLGDDDQSIEDDFNAWKESLWSELDKLLKDEDDKSVATPYT

AVIPEYRVVTHDPRFTTQKSMESNVANGNTTIDIHHPCRVDVAVQKELHTHESDRSCIHLEFDI

SRTGITYETGDHVGVYAENHVEIVEEAGKLLGHSLDLVFSIHADKEDGSPLESAVPPPFPGPCT

LGTGLARYADLLNPPRKSALVALAAYATEPSEAEKLKHLTSPDGKDEYSQWIVASQRSLLEVMA

AFPSAKPPLGVFFAAIAPRLQPRYYSISSSPRLAPSRVHVTSALVYGPTPTGRIHKGVCSTWMK

NAVPAEKSHECSGAPIFIRASNFKLPSNPSTPIVMVGPGTGLAPFRGFLQERMALKEDGEELGS

SLLFFGCRNRQMDFIYEDELNNFVDQGVISELIMAFSREGAQKEYVQHKMMEKAAQVWDLIKEE

GYLYVCGDAKGMARDVHRTLHTIVQEQEGVSSSEAEAIVKKLQTEGRYLRDVW

*Arabidopsis thaliana* CPR2 (AtCPR2)
(SEQ ID NO: 94)
MASSSSSSTSMIDLMAAIIKGEPVIVSDPANASAYESVAAELSSMLIENRQFAMIVTTSIAVL

IGCIVMLVWRRSGSGNSKRVEPLKPLVIKPREEEIDDGRKKVTIFFGTQTGTAEGFAKALGEEA

KARYEKTRFKIVDLDDYAADDDEYEEKLKKEDVAFFFLATYGDGEPTDNAARFYKWFTEGNDRG

EWLKNLKYGVFGLGNRQYEHFNKVAKVVDDILVEQGAQRLVQVGLGDDDQCIEDDFTAWREALW

PELDTILREEGDTAVATPYTAAVLEYRVSIHDSEDAKFNDINMANGNGYTVFDAQHPYKANVAV

KRELHTPESDRSCIHLEFDIAGSGLTYETGDHVGVLCDNLSETVDEALRLLDMSPDTYFSLHAE

KEDGTPISSSLPPPFPPCNLRTALTRYACLLSSPKKSALVALAAHASDPTEAERLKHLASPAGK

DEYSKWVVESQRSLLEVMAEFPSAKPPLGVFFAGVAPRLQPRFYSISSSPKIAETRIHVTCALV

YEKMPTGRIHKGVCSTWMKNAVPYEKSENCSSAPIFVRQSNFKLPSDSKVPIIMIGPGTGLAPF

RGFLQERLALVESGVELGPSVLFFGCRNRRMDFIYEEELQRFVESGALAELSVAFSREGPTKEY

VQHKMMDKASDIWNMISQGAYLYVCGDAKGMARDVHRSLHTIAQEQGSMDSTKAEGFVKNLQTS

GRYLRDVW

*Arabidopsis thaliana* (AtCPR3)

(SEQ ID NO: 95)

MASSSSSSTSMIDLMAAIIKGEPVIVSDPANASAYESVAAELSSMLIENRQFAMIVTTSIAVL

IGCIVMLVWRRSGSGNSKRVEPLKPLVIKPREEEIDDGRKKVTIFFGTQTGTAEGFAKALGEEA

KARYEKTRFKIVDLDDYAADDDEYEEKLKKEDVAFFFLATYGDEPTDNAARFYKWFTEGNDRG

EWLKNLKYGVFGLGNRQYEHFNKVAKVVDDILVEQGAQRLVQVGLGDDDQCIEDDFTAWREALW

PELDTILREEGDTAVATPYTAAVLEYRVSIHDSEDAKFNDITLANGNGYTVFDAQHPYKANVAV

KRELHTPESDRSCIHLEFDIAGSGLTMKLGDHVGVLCDNLSETVDEALRLLDMSPDTYFSLHAE

KEDGTPISSSLPPPFPPCNLRTALTRYACLLSSPKKSALVALAAHASDPTEAERLKHLASPAGK

DEYSKWVVESQRSLLEVMAEFPSAKPPLGVFFAGVAPRLQPRFYSISSSPKIAETRIHVTCALV

YEKMPTGRIHKGVCSTWMKNAVPYEKSEKLFLGRPIFVRQSNFKLPSDSKVPIIMIGPGTGLAP

FRGFLQERLALVESGVELGPSVLFFGCRNRRMDFIYEEELQRFVESGALAELSVAFSREGPTKE

YVQHKMMDKASDIWNMISQGAYLYVCGDAKGMARDVHRSLHTIAQEQGSMDSTKAEGFVKNLQT

SGRYLRDVW

*Stevia rebaudiana* CPR2 (SrCPR2)

(SEQ ID NO: 96)

MAQSESVEASTIDLMTAVLKDTVIDTANASDNGDSKMPPALAMMFEIRDLLLILTTSVAVLVGC

FVVLVWKRSSGKKSGKELEPPKIVVPKRRLEQEVDDGKKKVTIFFGTQTGTAEGFAKALFEEAK

ARYEKAAFKVIDLDDYAADLDEYAEKLKKETYAFFFLATYGDGEPTDNAAKFYKWFTEGDEKGV

WLQKLQYGVFGLGNRQYEHFNKIGIVVDDGLTEQGAKRIVPVGLGDDDQSIEDDFSAWKELVWP

ELDLLLRDEDDKAAATPYTAAIPEYRVVFHDKPDAFSDDHTQTNGHAVHDAQHPCRSNVAVKKE

LHTPESDRSCTHLEFDISHTGLSYETGDHVGVYCENLIEVVEEAGKLLGLSTDTYFSLHIDNED

GSPLGGPSLQPPFPPCTLRKALTNYADLLSSPKKSTLLALAAHASDPTEADRLRFLASREGKDE

YAEWVVANQRSLLEVMEAFPSARPPLGVFFAAVAPRLQPRYYSISSSPKMEPNRIHVTCALVYE

KTPAGRIHKGICSTWMKNAVPLTESQDCSWAPIFVRTSNFRLPIDPKVPVIMIGPGTGLAPFRG

FLQERLALKESGTELGSSILFFGCRNRKVDYIYENELNNFVENGALSELDVAFSRDGPTKEYVQ

HKMTQKASEIWNMLSEGAYLYVCGDAKGMAKDVHRTLHTIVQEQGSLDSSKAELYVKNLQMSGR

YLRDVW

*Stevia rebaudiana* CPR3 (SrCPR3)

(SEQ ID NO: 97)

MAQSNSVKISPLDLVTALFSGKVLDTSNASESGESAMLPTIAMIMENRELLMILTTSVAVLIGC

VVVLVWRRSSTKKSALEPPVIVVPKRVQEEEVDDGKKKVTVFFGTQTGTAEGFAKALVEEAKAR

YEKAVFKVIDLDDYAADDDEYEEKLKKESLAFFFLATYGDGEPTDNAARFYKWFTEGDAKGEWL

NKLQYGVFGLGNRQYEHFNKIAKVVDDGLVEQGAKRLVPVGLGDDDQCIEDDFTAWKELVWPEL

DQLLRDEDDTTVATPYTAAVAEYRVVFHEKPDALSEDYSYTNGHAVHDAQHPCRSNVAVKKELH

SPESDRSCTHLEFDISNTGLSYETGDHVGVYCENLSEVVNDAERLVGLPPDTYFSIHTDSEDGS

PLGGASLPPPFPPCTLRKALTCYADVLSSPKKSALLALAAHATDPSEADRLKFLASPAGKDEYS

QWIVASQRSLLEVMEAFPSAKPSLGVFFASVAPRLQPRYYSISSSPKMAPDRIHVTCALVYEKT

PAGRIHKGVCSTWMKNAVPMTESQDCSWAPIYVRTSNFRLPSDPKVPVIMIGPGTGLAPFRGFL

-continued

QERLALKEAGTDLGLSILFFGCRNRKVDFIYENELNNFVETGALSELIVAFSREGPTKEYVQHK

MSEKASDIWNLLSEGAYLYVCGDAKGMAKDVHRTLHTIVQEQGSLDSSKAELYVKNLQMSGRYL

RDVW

*Artemisia annua* CPR (AaCPR)
(SEQ ID NO: 98)
MAQSTTSVKLSPFDLMTALLNGKVSFDTSNTSDTNIPLAVFMENRELLMILTTSVAVLIGCVVV

LVWRRSSSAAKKAAESPVIVVPKKVTEDEVDDGRKKVTVFFGTQTGTAEGFAKALVEEAKARYE

KAVFKVIDLDDYAAEDDEYEEKLKKESLAFFFLATYGDGEPTDNAARFYKWFTEGEEKGEWLDK

LQYAVFGLGNRQYEHFNKIAKVVDEKLVEQGAKRLVPVGMGDDDQCIEDDFTAWKELVWPELDQ

LLRDEDDTSVATPYTAAVAEYRVVFHDKPETYDQDQLTNGHAVHDAQHPCRSNVAVKKELHSPL

SDRSCTHLEFDISNTGLSYETGDHVGVYVENLSEVVDEAEKLIGLPPHTYFSVHADNEDGTPLG

GASLPPPFPPCTLRKALASYADVLSSPKKSALLALAAHATDSTEADRLKFLASPAGKDEYAQWI

VASHRSLLEVMEAFPSAKPPLGVFFASVAPRLQPRYYSISSSPRFAPNRIHVTCALVYEQTPSG

RVHKGVCSTWMKNAVPMTESQDCSWAPIYVRTSNFRLPSDPKVPVIMIGPGTGLAPFRGFLQER

LAQKEAGTELGTAILFFGCRNRKVDFIYEDELNNFVETGALSELVTAFSREGATKEYVQHKMTQ

KASDIWNLLSEGAYLYVCGDAKGMAKDVHRTLHTIVQEQGSLDSSKAELYVKNLQMAGRYLRDV

W

CPR (PgCPR)
(SEQ ID NO: 99)
MAQSSSGSMSPFDFMTAIIKGKMEPSNASLGAAGEVTAMILDNRELVMILTTSIAVLIGCVVVF

IWRRSSSQTPTAVQPLKPLLAKETESEVDDGKQKVTIFFGTQTGTAEGFAKALADEAKARYDKV

TFKVVDLDDYAADDEEYEEKLKKETLAFFFLATYGDGEPTDNAARFYKWFLEGKERGEWLQNLK

FGVFGLGNRQYEHFNKIAIVVDEILAEQGGKRLISVGLGDDDQCIEDDFTAWRESLWPELDQLL

RDEDDTTVSTPYTAAVLEYRVVFHDPADAPTLEKSYSNANGHSVVDAQHPLRANVAVRRELHTP

ASDRSCTHLEFDISGTGIAYETGDHVGVYCENLAETVEEALELLGLSPDTYFSVHADKEDGTPL

SGSSLPPPFPPCTLRTALTLHADLLSSPKKSALLALAAHASDPTEADRLRHLASPAGKDEYAQW

IVASQRSLLEVMAEFPSAKPPLGVFFASVAPRLQPRYYSISSSPRIAPSRIHVTCALVYEKTPT

GRVHKGVCSTWMKNSVPSEKSDECSWAPIFVRQSNFKLPADAKVPIIMIGPGTGLAPFRGFLQE

RLALKEAGTELGPSILFFGCRNSKMDYIYEDELDNFVQNGALSELVLAFSREGPTKEYVQHKMM

EKASDIWNLISQGAYLYVCGDAKGMARDVHRTLHTIAQEQGSLDSSKAESMVKNLQMSGRYLRD

VW

Non-heme iron oxidase
*Acetobacter pasteurianus* subsp. *ascendens* (ApGA2ox)
(SEQ ID NO: 100)
MSVSKTTETFTSIPVIDISKLYSSDLAERKAVAEKLGDAARNIGFLYISGHNVSADLIEGVRKA

ARDFFAEPFEKKMEYYIGTSATHKGFVPEGEEVYSAGRPDHKEAFDIGYEVPANHPLVQAGTPL

LGPNNWPDIPGFRSAAEAYYRTVFDLGRTLFRGFALALGLNESYFDTVANFPPSKLRMIHYPYD

ADAQDAPGIGAHTDYECFTILLADKPGLEVMNGNGDWIDAPPIPGAFVVNIGDMLEVMTAGEFV

ATAHRVRKVSEERYSFPLFYACDYHTQIRPLPAFAKKIDASYETITIGEHMWAQALQTYQYLVK

KVEKGELKLPKGARKTATFGHFKRNSAA

*Cucurbita maxima* (CmGA2ox)
(SEQ ID NO: 101)
MAAASSFSAAFYSGIPLIDLSAPDAKQLIVKACEELGFFKVVKHGVPMELISSLESESTKFFSL

PLSEKQRAGPPSPFGYGNKQIGRNGDVGWVEYLLLNTHLESNSDGFLSMFGQDPQKLRSAVNDY

ISAVRNMAGEILELMAEGLKIQQRNVFSKLVMDEQSDSVFRVNHYPPCPDLQALKGTNMIGFGE

-continued

HTDPQIISVLRSNNTSGFQISLADGNWISVPPDHSSFFINVGDSLQVMTNGRFKSVKHRVLTNS

SKSRVSMIYFGGPPLSEKIAPLASLMQGEERSLYKEFTWFEYKRSAYNSRLADNRLVPFERIAA

S

Dendrobium catenatum (DcGA3ox)
(SEQ ID NO: 102)
MPSLSKEHFDLYSAFHVPETHAWSSSHLHDHPIAGDGATIPVIDISDPDAASMVGGACRSWGVF

YATSHGIPADLLHQVESHARRLFSLPLHRKLQTAPRDGSLSGYGRPPISAFFPKLMWSEGFTLA

GHDDHLAVTSQLSPFDSLSFCEVMEAYRKEMKKLAGRLFRLLILSLGLEEEEMGQVGPLKELSQ

AADAIQLNSYPTCPEPERAIGMAAHTDSAFLTVLHQTDGAGGLQVLRDQDESGSARWVDVLPRP

DCLVVNVGDLLHILSNGRFKSVRHRAVVNRADHRISAAYFIGPPAHMKVGSITKLVDMRTGPMY

RPVTWPEYLGIRTRLFDKALDSVKFQEKELEKD

Cucurbita maxima (CmGA3ox)
(SEQ ID NO: 103)
MATTIADVFKSFPVHIPAHKNLDFDSLHELPDSYAWIQPDSFPSPTHKHHNSILDSDSDSVPLI

DLSLPNAAALIGNAFRSWGAFQVINHGVPISLLQSIESSADTLFSLPPSHKLKAARTPDGISGY

GLVRISSFFPKRMWSEGFTIVGSPLDHFRQLWPHDYHKCEIVEEYDREMRSLCGRLMWLGLGE

LGITRDDMKWAGPDGDFKTSPAATQFNSYPVCPDPDRAMGLGPHTDTSLLTIVYQSNTRGLQVL

REGKRWVTVEPVAGGLVVQVGDLLHILTNGLYPSALHQAVVNRTKRLSVAYVFGPPESAEISP

LKKLLGPTQPPLYRPVTWTEYLGKKAEHFNNALSTVRLCAPITGLLDVNDHSRVKVG

Cucurbita maxima (CmGA20ox)
(SEQ ID NO: 104)
MHVVTSTPEARHDGAPLVFDASVLRHQHNIPKQFIWPDEEKPAATCPELEVPLIDLSGFLSGEK

DAAAEAVRLVGEACEKHGFFLVVNHGVDRKLIGEAHKYMDEFFELPLSQKQSAQRKAGEHCGYA

SSFTGRFSSKLPWKETLSFRFAADESLNNLVLHYLNDKLGDQFAKFGRVYQDYCEAMSGLSLGI

MELLGKSLGVEEQCFKNFFKDNDSIMRLNFYPPCQKPHLTLGTGPHCDPTSLTILHQDQVGGLQ

VFVDNQWRLITPNFDAFVVNIGDTFMALSNGRYKSCLHRAVVNSERTRKSLAFFLCPRNDKVVR

PPRELVDTQNPRRYPDFTWSMLLRFTQTHYRADMKTLEAFSAWLQQEQQEQQEQQFNI

Agapanthus praecox subsp. orientalis (ApoGA20ox)
(SEQ ID NO: 105)
MVLQPFVFDAALLRDEHNIPTQFIWPEEDKPSPDASEELILPFIDLKAFLSGDPDSPFQVSKQV

GEACESLGAFQVTNHGIDFDLLEEAHSCIQKFFSMPLCEKQRALRKAGESYGYASSFTGRFCSK

LPWKETLSFRYSSSSSDIVQNYFVRTLGEEFRHFGEVYQKYCESMSKLSLMIMEVLGLSLGVGR

MHFREFFEGNDSTMRLNYYPPCKKPDLTLGTGPHCDPTSLTILHQDDVSGLQVFTGGKWLTVRP

KTDAFVVNIGDTFTALSNGRYKSCLHRAVVNSKTARKSLAFFLCPAMNKIVRPPRELVDIDHPR

AYPDFTWSALLEFTQKHYRADMQTLNEFSKYILQAQGTLHK

Arabidopsis thaliana (AtF3H)
(SEQ ID NO: 106)
MAPGTLTELAGESKLNSKFVRDEDERPKVAYNVFSDEIPVISLAGIDDVDGKRGEICRQIVEAC

ENWGIFQVVDHGVDTNLVADMTRLARDFFALPPEDKLRFDMSGGKKGGFIVSSHLQGEAVQDWR

EIVTYFSYPVRNRDYSRWPDKPEGWVKVTEEYSERLMSLACKLLEVLSEAMGLEKESLTNACVD

MDQKIVVNYYPKCPQPDLTLGLKRHTDPGTITLLLQDQVGGLQATRDNGKTWITVQPVEGAFVV

NLGDHGHFLSNGRFKNADHQAVVNSNSSRLSIATFQNPAPDATVYPLKVREGEKAILEEPITFA

EMYKRKMGRDLELARLKKLAKEERDHKEVDKPVDQIFA

Chrysosplenium americanum (CaF6H)
(SEQ ID NO: 107)
QEKTLNSRFVARDEDSLERPKVSAIYNGSFDEIPVLISLAGIDMTGAGTDAAARRSEICRKIVE

ACEDWGIFGEIDDDHGKRAEICDKIVKACEDWGVFQPDEKLESVMSAAKKGDFVVDHGVDAEVI

-continued

SQWTTFAKPTSHTQFETETTRDFPNKPEGWKATTEQYSRTLMGLACKLLGVISEAMGLEKEALT

KACVDMDQKVVVNYYPKCPQPDLTLGLKRHTDPGTITLLLQDQVGGLQATRDGGKTWITVQPVK

DNGWILLHIGDSNGHRHGHFLSNGRFKSHQAYRYRRPTRGSPTFGTKVSNYPPCPEQSLVRPPA

GRPYGRALNALDAKKLASAKQQLESAAILLISELAVAYIILAILPSSEIIAEEGYL

Datura stramonium (DsH6H)
(SEQ ID NO: 108)
MATFVSNWSTNNVSESFIAPLEKRAEKDVALGNDVPIIDLQQDHLLIVQQITKACQDFGLFQVI

NHGVPEKLMVEAMEVYKEFFALPAEEKEKFQPKGEPAKFELPLEQKAKLYVEGERRCNEEFLYW

KDTLAHGCYPLHEELLNSWPEKPPTYRDVIAKYSVEVRKLTMRILDYICEGLGLKLGYFDNELT

QIQMLLANYYPSCPDPSSTIGSGGHYDGNLITLLQQDLVGLQQLIVKDDKWIAVEPIPTAFVVN

LGLTLKVMSNEKFEGSIHRVVTHPTRNRISIGTLIGPDYSCTIEPIKELLSQENPPLYKPYPYA

KFAEIYLSDKSDYDAGVKPYKINQFPN

Arabidopsis thaliana (AtH6DH)
(SEQ ID NO: 109)
MENHTTMKVSSLNCIDLANDDLNHSVVSLKQACLDCGFFYVINHGISEEFMDDVFEQSKKLFAL

PLEEKMKVLRNEKHRGYTPVLDELLDPKNQINGDHKEGYYIGIEVPKDDPHWDKPFYGPNPWPD

ADVLPGWRETMEKYHQEALRVSMAIARLLALALDLDVGYFDRTEMLGKPIATMRLLRYQGISDP

SKGIYACGAHSDFGMMTLLATDGVMGLQICKDKNAMPQKWEYVPPIKGAFIVNLGDMLERWSNG

FFKSTLHRVLGNGQERYSIPFFVEPNHDCLVECLPTCKSESELPKYPPIKCSTYLTQRYEETHA

NLSIYHQQT

Solanum lycopersicum (SlF35H)
(SEQ ID NO: 110)
MALRINELFVAAIIYIIVHIIISKLITTVRERGRRLPLPPGPTGWPVIGALPLLGSMPHVALAK

MAKKYGPIMYLKVGTCGMVVASTPNAAKAFLKTLDINFSNRPPNAGATHLAYNAQDMVFAPYGP

RWKLLRKLSNLHMLGGKALENWANVRANELGHMLKSMFDASQDGECVVIADVLTFAMANMIGQV

MLSKRVFVEKGVEVNEFKNMVVELMTVAGYFNIGDFIPKLAWMDIQGIEKGMKNLHKKFDDLLT

KMFDEHEATSNERKENPDFLDVVMANRDNSEGERLSTTNIKALLLNLFTAGTDTSSSVIEWALA

EMMKNPKIFEKAQQEMDQVIGKNRRLIESDIPNLPYLRAICKETFRKHPSTPLNLPRVSSEPCT

VDGYYIPKNTRLSVNIWAIGRDPDVWENPLEFTPERFLSGKNAKIEPRGNDFELIPFGAGRRIC

AGTRMGIVMVEYILGTLVHSFDWKLPNNVIDINMEESFGLALQKAVPLEAMVTPRLSLDVYRC

D4H
(SEQ ID NO: 111)
MPKSWPIVISSHSFCFLPNSEQERKMKDLNFHAATLSEEESLRELKAFDETKAGVKGIVDTGIT

KIPRIFIDQPKNLDRISVCRGKSDIKIPVINLNGLSSNSEIRREIVEKIGEASEKYGFFQIVNH

GIPQDVMDKMVDGVRKFHEQDDQIKRQYYSRDRFNKNFLYSSNYVLIPGIACNWRDTMECIMNS

NQPDPQEFPDVCRDILMKYSNYVRNLGLILFELLSEALGLKPNHLEEMDCAEGLILLGHYYPAC

PQPELTFGTSKHSDSGFLTILMQDQIGGLQILLENQWIDVPFIPGALVINIADLLQLITNDKFK

SVEHRVLANKVGPRISVAVAFGIKTQTQEGVSPRLYGPIKELISEENPPIYKEVTVKDFITIRF

AKRFDDSSSLSPFRLNN

Catharanthus roseus (CrD4Hlike)
(SEQ ID NO: 112)
MKELNNSEEELKAFDDTKAGVKALVDSGITEIPRIFLDHPTNLDQISSKDREPKFKKNIPVIDL

DGISTNSEIRREIVEKIREASEKWGFFQIVNHGIPQEVMDDMIVGIRRFHEQDNEIKKQFYTRD

RTKSFRYTSNFVLNPKIACNWRDTFECTMAPHQPNPQDLPDICRDIMMKYISYTRNLGLTLFEL

LSEALGLKSNRLKDMHCDEGVELVGHYYPACPQPELTLGTSKHTDTGFLTMLQQDQIGGLQVLY

ENHQWVDVPFIPGALIINIGDFLQIISNDKFKSAPHRVLANKNGPRISTASVFMPNFLESAEVR

LYGPIKELLSEENPPIYEQITAKDYVTVQFSRGLDGDSFLSPFMLNKDNMEK

Zea mays (ZmBX6)
(SEQ ID NO: 113)
MAPTTATKDDSGYGDERRRELQAFDDTKLGVKGLVDSGVKSIPSIFHHPPEALSDIISPAPLPS

SPPSGAAIPVVDLSVTRREDLVEQVRHAAGTVGFFWLVNHGVAEELMGGMLRGVRQFNEGPVEA

KQALYSRDLARNLRFASNFDLFKAAAADWRDTLFCEVAPNPPPREELPEPLRNVMLEYGAAVTK

LARFVFELLSESLGMPSDHLYEMECMQNLNVVCQYYPPCPEPHRTVGVKRHTDPGFFTILLQDG

MGGLQVRLGNNGQSGGCWVDIAPRPGALMVNIGDLLQLVTNDRFRSVEHRVPANKSSDTARVSV

ASFFNTDVRRSERMYGPIPDPSKPPLYRSVRARDFIAKFNTIGLDGRALDHFRL

Hordeum vulgare subsp. vulgare (HvIDS2)
(SEQ ID NO: 114)
MAKVMNLTPVHASSIPDSFLLPADRLHPATTDVSLPIIDMSRGRDEVRQAILDSGKEYGFIQVV

NHGISEPMLHEMYAVCHEFFDMPAEDKAEFFSEDRSERNKLFCGSAFETLGEKYWIDVLELLYP

LPSGDTKDWPHKPQMLREVVGNYTSLARGVAMEILRLLCEGLGLRPDFFVGDISGGRVVVDINY

YPPSPNPSRTLGLPPHCDRDLMTVLLPGAVPGLEIAYKGGWIKVQPVPNSLVINFGLQLEVVTN

GYLKAVEHRAATNFAEPRLSVASFIVPADDCVVGPAEEFVSEDNPPRYRTLTVGEFKRKHNVVN

LDSSINQIININNNQKGI

Hordeum vulgare subsp. vulgare (HvIDS3)
(SEQ ID NO: 115)
MENILHATPAPVSLPESFVFASDKVPPATKAVVSLPIIDLSCGRDEVRRSILEAGKELGFFQVV

NHGVSKQVMRDMEGMCEQFFHLPAADKASLYSEERHKPNRLFSGATYDTGGEKYWRDCLRLACP

FPVDDSINEWPDTPKGLRDVIEKFTSQTRDVGKELLRLLCEGMGIRADYFEGDLSGGNVILNIN

HYPSCPNPDKALGQPPHCDRNLITLLLPGAVNGLEVSYKGDWIKVDPAPNAFVVNFGQQLEVVT

NGLLKSIEHRAMTNSALARTSVATFIMPTQECLIGPAKEFLSKENPPCYRTTMFRDFMRIYNVV

KLGSSLNLTTNLKNVQKEI

Uridine diphosphate dependent glycosyltransferase (UGT)
Siraitia grosvenorii UGT720-269-1
(SEQ ID NO: 116)
MEDRNAMDMSRIKYRPQPLRPASMVQPRVLLFPFPALGHVKPFLSLAELLSDAGIDVVFLSTEY

NHRRISNTEALASRFPTLHFETIPDGLPPNESRALADGPLYFSMREGTKPRFRQLIQSLNDGRW

PITCIITDIMLSSPIEVAEEFGIPVIAFCPCSARYLSIHFFIPKLVEEGQIPYADDDPIGEIQG

VPLFEGLLRRNHLPGSWSDKSADISFSHGLINQTLAAGRASALILNTFDELEAPFLTHLSSIFN

KIYTIGPLHALSKSRLGDSSSSASALSGFWKEDRACMSWLDCQPPRSVVFVSFGSTMKMKADEL

REFWYGLVSSGKPFLCVLRSDVVSGGEAAELIEQMAEEEGAGGKLGMVVEWAAQEKVLSHPAVG

GFLTHCGWNSTVESIAAGVPMMCWPILGDQPSNATWIDRVWKIGVERNNREWDRLTVEKMVRAL

MEGQKRVEIQRSMEKLSKLANEKVVRGINLHPTISLKKDTPTTSEHPRHEFENMRGMNYEMLVG

NAIKSPTLTKK

Siraitia grosvenorii UGT94-289-3
(SEQ ID NO: 117)
MTIFFSVEILVLGIAEFAAIAMDAAQQGDTTTILMLPWLGYGHLSAFLELAKSLSRRNFHIYFC

STSVNLDAIKPKLPSSFSDSIQFVELHLPSSPEFPPHLHTTNGLPPTLMPALHQAFSMAAQHFE

SILQTLAPHLLIYDSLQPWAPRVASSLKIPAINFNTTGVFVISQGLHPIHYPHSKFPFSEFVLH

NHWKAMYSTADGASTERTRKRGEAFLYCLHASCSVILINSFRELEGKYMDYLSVLLNKKVVPVG

PLVYEPNQDGEDEGYSSIKNWLDKKEPSSTVFVSFGSEYFPSKEEMEEIAHGLEASEVNFIWVV

RFPQGDNTSGIEDALPKGFLERAGERGMVVKGWAPQAKILKHWSTGGFVSHCGWNSVMESMMFG

-continued

VPIIGVPMHVDQPFNAGLVEEAGVGVEAKRDPDGKIQRDEVAKLIKEVVVEKTREDVRKKAREM

SEILRSKGEEKFDEMVAEISLLLKI

*Siraitia grosvenorii* UGT74-345-2

(SEQ ID NO: 118)

MDETTVNGGRRASDVVVFAFPRHGHMSPMLQFSKRLVSKGLRVTFLITTSATESLRLNLPPSSS

LDLQVISDVPESNDIATLEGYLRSFKATVSKTLADFIDGIGNPPKFIVYDSVMPWVQEVARGRG

LDAAPFFTQSSAVNHILNHVYGGSLSIPAPENTAVSLPSMPVLQAEDLPAFPDDPEVVMNFMTS

QFSN FQDAKWIFFNTFDQLECKKQSQWNWMADRWPIKTVGPTIPSAYLDDGRLEDDRAFGLNL

LKPEDGKNTRQWQWLDSKDTASVLYISFGSLAILQEEQVKELAYFLKDTNLSFLWVLRDSELQK

LPHNFVQETSHRGLVVNWCSQLQVLSHRAVSCFVTHCGWNSTLEALSLGVPMVAIPQWVDQTTN

AKFVADVWRVGVRVKKKDERIVTKEELEASIRQVVQGEGRNEFKHNAIKWKKLAKEAVDEGGSS

DKNIEEFVKTIA

*Siraitia grosvenorii* UGT75-281-2

(SEQ ID NO: 119)

MGDNGDGGEKKELKENVKKGKELGRQAIGEGYINPSLQLARRLISLGVNVTFATTVLAGRRMKN

KTHQTATTPGLSFATFSDGFDDETLKPNGDLTHYFSELRRCGSESLTHLITSAANEGRPITFVI

YSLLLSWAADIASTYDIPSALFFAQPATVLALYFYYFHGYGDTICSKLQDPSSYIELPGLPLLT

SQDMPSFFSPSGPHAFILPPMREQAEFLGRQSQPKVLVNTFDALEADALRAIDKLKMLAIGPLI

PSALLGGNDSSDASFCGDLFQVSSEDYIEWLNSKPDSSVVYISVGSICVLSDEQEDELVHALLN

SGHTFLWVKRSKENNEGVKQETDEEKLKKLEEQGKMVSWCRQVEVLKHPALGCFLTHCGWNSTI

ESLVSGLPVVAFPQQIDQATNAKLIEDVWKTGVRVKANTEGIVEREEIRRCLDLVMGSRDGQKE

EIERNAKKWKELARQAIGEGGSSDSNLKTFLWEIDLEI

*Siraitia grosvenorii* UGT720-269-4

(SEQ ID NO: 120)

MAEQAHDLLHVLLFPFPAEGHIKPFLCLAELLCNAGFHVTFLNTDYNHRRLHNLHLLAARFPSL

HFESISDGLPPDQPRDILDPKFFISICQVTKPLFRELLLSYKRISSVQTGRPPITCVITDVIFR

FPIDVAEELDIPVFSFCTFSARFMFLYFWIPKLIEDGQLPYPNGNINQKLYGVAPEAEGLLRCK

DLPGHWAFADELKDDQLNFVDQTTASSRSSGLILNTFDDLEAPFLGRLSTIFKKIYAVGPIHSL

LNSHHCGLWKEDHSCLAWLDSRAAKSVVFVSFGSLVKITSRQLMEFWHGLLNSGKSFLFVLRSD

VVEGDDEKQVVKEIYETKAEGKWLVVGWAPQEKVLAHEAVGGFLTHSGWNSILESIAAGVPMIS

CPKIGDQSSNCTWISKVWKIGLEMEDRYDRVSVETMVRSIMEQEGEKMQKTIAELAKQAKYKVS

KDGTSYQNLECLIQDIKKLNQIEGFINNPNFSDLLRV

*Siraitia grosvenorii* UGT94-289-2

(SEQ ID NO: 121)

MDAQQGHTTTILMLPWVGYGHLLPFLELAKSLSRRKLFHIYFCSTSVSLDAIKPKLPPSISSDD

SIQLVELRLPSSPELPPHLHTTNGLPSHLMPALHQAFVMAAQHFQVILQTLAPHLLIYDILQPW

APQVASSLNIPAINFSTTGASMLSRTLHPTHYPSSKFPISEFVLHNHWRAMYTTADGALTEEGH

KIEETLANCLHTSCGVVLVNSFRELETKYIDYLSVLLNKKVVPVGPLVYEPNQEGEDEGYSSIK

NWLDKKEPSSTVFVSFGTEYFPPSKEEMEEIAYGLELSEVNFIWVLRFPQGDSTSTIEDALPKGF

LERAGERAMVVKGWAPQAKILKHWSTGGLVSHCGWNSMMEGMMFGVPIIAVPMHLDQPFNAGLV

EEAGVGVEAKRDSDGKIQREEVAKSIKEVVIEKTREDVRKKAREMDTKHGPTYFSRSKVSSFGR

LYKINRPTTLTVGRFWSKQIKMKRE

*Siraitia grosvenorii* UGT94-289-1

(SEQ ID NO: 122)

MDAQRGHTTTILMFPWLGYGHLSAFLELAKSLSRRNFHIYFCSTSVNLDAIKPKLPSSSSSDSI

QLVELCLPSSPDQLPPHLHTTNALPPHLMPTLHQAFSMAAQHFAAILHTLAPHLLIYDSFQPWA

-continued

PQLASSLNIPAINFNTTGASVLTRMLHATHYPSSKFPISEFVLHDYWKAMYSAAGGAVTKKDHK
IGETLANCLHASCSVILINSFRELEEKYMDYLSVLLNKKVVPVGPLVYEPNQDGEDEGYSSIKN
WLDKKEPSSTVFVSFGSEYFPSKEEMEEIAHGLEASEVHFIWVVRFPQGDNTSAIEDALPKGFL
ERVGERGMVVKGWAPQAKILKHWSTGGFVSHCGWNSVMESMMFGVPIIGVPMHLDQPFNAGLAE
EAGVGVEAKRDPDGKIQRDEVAKLIKEVVVEKTREDVRKKAREMSEILRSKGEEKMDEMVAAIS
LFLKI

*Momordica charantia* 1 (McUGT1)
(SEQ ID NO: 123)
MAQPQTQARVLVFPYPTVGHIKPFLSLAELLADGGLDVVFLSTEYNHRRIPNLEALASRFPTLH
FDTIPDGLPIDKPRVIIGGELYTSMRDGVKQRLRQVLQSYNDGSSPITCVICDVMLSGPIEAAE
ELGIPVVTFCPYSARYLCAHFVMPKLIEEGQIPFTDGNLAGEIQGVPLFGGLLRRDHLPGFWFV
KSLSDEVWSHAFLNQTLAVGRTSALIINTLDELEAPFLAHLSSTFDKIYPIGPLDALSKSRLGD
SSSSSTVLTAFWKEDQACMSWLDSQPPKSVIFVSFGSTMRMTADKLVEFWHGLVNSGTRFLCVL
RSDIVEGGGAADLIKQVGETGNGIVVEWAAQEKVLAHRAVGGFLTHCGWNSTMESIAAGVPMMC
WQIYGDQMINATWIGKVWKIGIERDDKWDRSTVEKMIKELMEGEKGAEIQRSMEKFSKLANDKV
VKGGTSFENLELIVEYLKKLKPSN

*Momordica charantia* 2 (McUGT2)
(SEQ ID NO: 124)
MAQPRVLLFPFPAMGHVKPFLSLAELLSDAGVEVVFLSTEYNHRRIPDIGALAARFPTLHFETI
PDGLPPDQPRVLADGHLYFSMLDGTKPRFRQLIQSLNGNPRPITCIINDVMLSSPIEVAEEFGI
PVIAFCPCSARFLSVHFFMPNFIEEAQIPYTDENPMGKIEEATVFEGLLRRKDLPGLWCAKSSN
ISFSHRFINQTIAAGRASALILNTFDELESPFLNHLSSIFPKIYCIGPLNALSRSRLGKSSSSS
SALAGFWKEDQAYMSWLESQPPRSVIFVSFGSTMKMEAWKLAEFWYGLVNSGSPFLFVFRPDCV
INSGDAAEVMEGRGRGMVVEWASQEKVLAHPAVGGFLTHCGWNSTVESIVAGVPMMCCPIVADQ
LSNATWIHKVWKIGIEGDEKWDRSTVEMMIKELMESQKGTEIRTSIEMLSKLANEKVVKGGTSL
NNFELLVEDIKTLRRPYT

*Momordica charantia* 3 (McUGT3)
(SEQ ID NO: 125)
MEQSDSNSDDHQHHVLLFPFPAKGHIKPFLCLAQLLCGAGLQVTFLNTDHNHRRIDDRHRRLLA
TQFPMLHFKSISDGLPPDHPRDLLDGKLIASMRRVTESLFRQLLLSYNGYGNGTNNVSNSGRRP
PISCVITDVIFSFPVEVAEELGIPVFSFATFSARFLFLYFWIPKLIQEGQLPFPDGKTNQELYG
VPGAEGIIRCKDLPGSWSVEAVAKNDPMNFVKQTLASSRSSGLILNTFEDLEAPFVTHLSNTFD
KIYTIGPIHSLLGTSHCGLWKEDYACLAWLDARPRKSVVFVSFGSLVKTTSRELMELWHGLVSS
GKSFLLVLRSDVVEGEDEEQVVKEILESNGEGKWLVVGWAPQEEVLAHEAIGGFLTHSGWNSTM
ESIAAGVPMVCWPKIGDQPSNCTWVSRVWKVGLEMEERYDRSTVARMARSMMEQEGKEMERRIA
ELAKRVKYRVGKDGESYRNLESLIRDIKITKSSN

*Momordica charantia* 4 (McUGT4)
(SEQ ID NO: 126)
MDAHQQAEHTTTILMLPWVGYGHLTAYLELAKALSRRNFHIYYCSTPVNIESIKPKLTIPCSSI
QFVELHLPSSDDLPPNLHTTNGLPSHLMPTLHQAFSAAAPLFEEILQTLCPHLLIYDSLQPWAP
KIASSLKIPALNFNTSGVSVIAQALHAIHHPDSKFPLSDFILHNYWKSTYTTADGGASEKTRRA
REAFLYCLNSSGNAILINTFRELEGEYIDYLSLLLNKKVIPIGPLVYEPNQDEDQDEEYRSIKN
WLDKKEPCSTVFVSFGSEYFPSNEEMEEIAPGLEESGANFIWVVRFPKLENRNGIIEEGLLERA
GERGMVIKEWAPQARILRHGSIGGFVSHCGWNSVMESIICGVPVIGVPMRVDQPYNAGLVEEAG -continued

VGVEAKRDPDGKIQRHEVSKLIKQVVVEKTRDDVRKKVAQMSEILRRKGDEKIDEMVALISLLP

KG

Momordica charantia 5 (McUGT5)
(SEQ ID NO: 127)
MDARQQAEHTTTILMLPWVGYGHLSAYLELAKALSRRNFHIYYCSTPVNIESIKPKLTIPCSSI

QFVELHLPFSDDLPPNLHTTNGLPSHLMPALHQAFSAAAPLFEAILQTLCPHLLIYDSLQPWAP

QIASSLKIPALNFNTTGVSVIARALHTIHHPDSKFPLSEIVLHNYWKATHATADGANPEKFRRD

LEALLCCLHSSCNAILINTFRELEGEYIDYLSLLLNKKVTPIGPLVYEPNQDEEQDEEYRSIKN

WLDKKEPYSTIFVSFGSEYFPSNEEMEEIARGLEESGANFIWVVRFHKLENGNGITEEGLLERA

GERGMVIQGWAPQARILRHGSIGGFVSHCGWNSVMESIICGVPVIGVPMGLDQPYNAGLVEEAG

VGVEAKRDPDGKIQRHEVSKLIKQVVVEKTRDDVRKKVAQMSEILRRKGDEKIDEMVALISLLL

KG

Cucumis sativus
(SEQ ID NO: 128)
MGLSPTDHVLLFPFPAKGHIKPFFCLAHLLCNAGLRVTFLSTEHHHQKLHNLTHLAAQIPSLHF

QSISDGLSLDHPRNLLDGQLFKSMPQVTKPLFRQLLLSYKDGTSPITCVITDLILRFPMDVAQE

LDIPVFCFSTFSARFLFLYFSIPKLLEDGQIPYPEGNSNQVLHGIPGAEGLLRCKDLPGYWSVE

AVANYNPMNFVNQTIATSKSHGLILNTFDELEVPFITNLSKIYKKVYTIGPIHSLLKKSVQTQY

EFWKEDHSCLAWLDSQPPRSVMFVSFGSIVKLKSSQLKEFWNGLVDSGKAFLLVLRSDALVEET

GEEDEKQKELVIKEIMETKEEGRWVIVNWAPQEKVLEHKAIGGFLTHSGWNSTLESVAVGVPMV

SWPQIGDQPSNATWLSKVWKIGVEMEDSYDRSTVESKVRSIMEHEDKKMENAIVELAKRVDDRV

SKEGTSYQNLQRLIEDIEGFKLN

Cucurbita maxima 1 (CmaUGT1)
(SEQ ID NO: 129)
MELSHTHHVLLFPFPAKGHIKPFFSLAQLLCNAGLRVTFLNTDHHHRRIHDLNRLAAQLPTLHF

DSVSDGLPPDEPRNVFDGKLYESIRQVTSSLFRELLVSYNNGTSSGRPPITCVITDVMFRFPID

IAEELGIPVFTFSTFSARFLFLIFWIPKLLEDGQLRYPEQELHGVPGAEGLIRWKDLPGFWSVE

DVADWDPMNFVNQTLATSRSSGLILNTFDELEAPFLTSLSKIYKKIYSLGPINSLLKNFQSQPQ

YNLWKEDHSCMAWLDSQPRKSVVFVSFGSVVKLTSRQLMEFWNGLVNSGMPFLLVLRSDVIEAG

EEVVREIMERKAEGRWVIVSWAPQEEVLAHDAVGGFLTHSGWNSTLESLAAGVPMISWPQIGDQ

TSNSTWISKVWRIGLQLEDGFDSSTIETMVRSIMDQTMEKTVAELAERAKNRASKNGTSYRNFQ

TLIQDITNIIETHI

Cucurbita maxima 2 (CmaUGT2)
(SEQ ID NO: 130)
MDAQKAVDTPPTTVLMLPWIGYGHLSAYLELAKALSRRNFHVYFCSTPVNLDSIKPNLIPPPSS

IQFVDLHLPSSPELPPHLHTTNGLPSHLKPTLHQAFSAAAQHFEAILQTLSPHLLIYDSLQPWA

PRIASSLNIPAINFNTTAVSIIAHALHSVHYPDSKFPPSDFVLHDYWKAKYTTADGATSEKIRR

GAEAFLYCLNASCDVVLVNSFRELEGEYMDYLSVLLKKKVVSVGPLVYEPSEGEEDEEYWRIKK

WLDEKEALSTVLVSFGSEYFPSKEEMEEIAHGLEESEANFIWVVRFPKGEESCRGIEEALPKGF

VERAGERAMVVKKWAPQGKILKHGSIGGFVSHCGWNSVLESIRFGVPVIGVPMHLDQPYNAGLL

EEAGIGVEAKRDADGKIQRDQVASLIKRVVVEKTREDIWKTVREMREVLRRRDDDMIDEMVAEI

SVVLKI

Cucurbita maxima 3 (CmaUGT3)
(SEQ ID NO: 131)
MSSNLFLKISIPFGRLRDSALNCSVFHCKLHLAIAIAMDAQQAANKSPTATTIFMLPWAGYGHL

SAYLELAKALSTRNFHIYFCSTPVSLASIKPRLIPSCSSIQFVELHLPSSDEFPPHLHTTNGLP

-continued

SRLVPTFHQAFSEAAQTFEAFLQTLRPHLLIYDSLQPWAPRIASSLNIPAINFFTAGAFAVSHV

LRAFHYPDSQFPSSDFVLHSRWKIKNTTAESPTQAKLPKIGEAIGYCLNASRGVILTNSFRELE

GKYIDYLSVILKKRVFPIGPLVYQPNQDEEDEDYSRIKNWLDRKEASSTVLVSFGSEFFLSKEE

TEAIAHGLEQSEANFIWGIRFPKGAKKNAIEEALPEGFLERAGGRAMVVEEWVPQGKILKHGSI

GGFVSHCGWNSAMESIVCGVPIIGIPMQVDQPFNAGILEEAGVGVEAKRDSDGKIQRDEVAKLI

KEVVVERTREDIRNKLEKINEILRSRREEKLDELATEISLLSRN

*Cucurbita moschata* 1 (CmoUGT1)
(SEQ ID NO: 132)
MELSPTHHLLLFPFPAKGHIKPFFSLAQLLCNAGARVTFLNTDHHHRRIHDLDRLAAQLPTLHF

DSVSDGLPPDESRNVFDGKLYESIRQVTSSLFRELLVSYNNGTSSGRPPITCVITDCMFRFPID

IAEELGIPVFTFSTFSARFLFLFFWIPKLLEDGQLRYPEQELHGVPGAEGLIRCKDLPGFLSDE

DVAHWKPINFVNQILATSRSSGLILNTFDELEAPFLTSLSKIYKKIYSLGPINSLLKNFQSQPQ

YNLWKEDHSCMAWLDSQPPKSVVFVSFGSVVKLTNRQLVEFWNGLVNSGKPFLLVLRSDVIEAG

EEVVRENMERKAEGRWHIVSWAPQEEVLAHDAVGGFLTHSGWNSTLESLAAGVPMISWTQIGDQ

TSNSTWVSKVWRIGLQLEDGFDSFTIETMVRSVMDQTMEKTVAELAERAKNRASKNGTSYRNFQ

TLIQDITNIIETHI

*Cucurbita moschata* 2 (CmoUGT2)
(SEQ ID NO: 133)
MDAQKAVDTPPTTVLMLPWIGYGHLSAYLELAKALSRRNFHVYFCSTPVNLDSIKPNLIPPPPS

IQFVDLHLPSSPELPPHLHTTNGLPSHLKPTLHQAFSAAAQHFEAILQTLSPHLLIYDSLQPWA

PRIASSLNIPAINFNTTAVSIIAHALHSVHYPDSKFPFSDFVLHDYWKAKYTTADGATSEKTRR

GVEAFLYCLNASCDVVLVNSFRELEGEYMDYLSVLLKKKVVSVGPLVYEPSEGEEDEEYWRIKK

WLDEKEALSTVLVSFGSEYFPPKEEMEEIAHGLEESEANFIWVVRFPKGEESSSRGIEEALPKG

FVERAGERAMVVKKWAPQGKILKHGSIGGFVSHCGWNSVLESIRFGVPVIGAPMHLDQPYNAGL

LEEAGIGVEAKRDADGKIQRDQVASLIKQVVVEKTREDIWKKVREMREVLRRRDDDDMMIDEMV

AVISVVLKI

*Cucurbita moschata* 3 (CmoUGT3)
(SEQ ID NO: 134)
MDAQQAANKSPTASTIFMLPWVGYGHLSAYLELAKALSTRNFHVYFCSTPVSLASIKPRLIPSC

SSIQFVELHLPSSDEFPPHLHTTNGLPAHLVPTIHQAFAAAAQTFEAFLQTLRPHLLIYDSLQP

WAPRIASSLNIPAINFFTAGAFAVSHVLRAFHYPDSQFPSSDFVLHSRWKIKNTTAESPTQVKI

PKIGEAIGYCLNASRGVILTNSFRELEGKYIDYLSVILKKRVLPIGPLVYQPNQDEEDEDYSRI

KNWLDRKEASSTVLVSFGSEFFLSKEETEAIAHGLEQSEANFIWGIRFPKGAKKNAIEEALPEG

FLERVGGRAMVVEEWVPQGKILKHGNIGGFVSHCGWNSAMESIMCGVPVIGIPMQVDQPFNAGI

LEEAGVGVEAKRDSDGKIQRDEVAKLIKEVVVERTREDIRNKLEEINEILRTRREEKLDELATE

ISLLCKN

*Prunus persica*
(SEQ ID NO: 135)
MAMKQPHVIIFPFPPLQGHMKPLLCLAELLCHAGLHVTYVNTHHNHQRLANRQALSTHFPTLHFE

SISDGLPEDDPRTLNSQLLIALKTSIRPHFRELLKTISLKAESNDTLVPPPSCIMTDGLVTFAF

DVAEELGLPILSFNVPCPRYLWTCLCLPKLIENGQLPFQDDDMNVEITGVPGMEGLLHRQDLPG

FCRVKQADHPSLQFAINETQTLKRASALILDTVYELDAPCISHMALMFPKIYTLGPLHALLNSQ

IGDMSRGLASHGSLWKSDLNCMTWLDSQPSKSIIYVSFGTLVHLTRAQVIEFWYGLVNSGHPFL

WVMRSDITSGDHQIPAELENGTKERGCIVDWVSQEEVLAHKSVGGFLTHSGWNSTLESIVAGLP

```
MICWPKLGDHYIISSTVCRQWKIGLQLNENCDRSNIESMVQTLMGSKREEIQSSMDAISKLSRD

SVAEGGSSHNNLEQLIEYIRNLQHQN
```

Theobroma cacao (SEQ ID NO: 136)
```
MRQPHVLVLPFPAQGHIKPMLCLAELLCQAGLRVTFLNTHHSHRRLNNLQDLSTRFPTLHFESV

SDGLPEDHPRNLVHFMHLVHSIKNVTKPLLRDLLTSLSLKTDIPPVSCIIADGILSFAIDVAEE

LQIKVIIFRTISSCCLWSYLCVPKLIQQGELQFSDSDMGQKVSSVPEMKGSLRLHDRPYSFGLK

QLEDPNFQFFVSETQAMTRASAVIFNTFDSLEAPVLSQMIPLLPKVYTIGPLHALRKARLGDLS

QHSSFNGNLREADHNCITWLDSQPLRSVVYVSFGSHVVLTSEELLEFWHGLVNSGKRFLWVLRP

DIIAGEKDHNQIIAREPDLGTKEKGLLVDWAPQEEVLAHPSVGGFLTHCGWNSTLESMVAGVPM

LCWPKLPDQLVNSSCVSEVWKIGLDLKDMCDRSTVEKMVRALMEDRREEVMRSVDGISKLARES

VSHGGSSSSNLEMLIQELET
```

Corchorus capsularis (SEQ ID NO: 137)
```
MDSKQKKMSVLMFPWLAYGHISPFLELAKKLSKRNFHTFFFSTPINLNSIKSKLSPKYAQSIQF

VELHLPSLPDLPPHYHTTNGLPPHLMNTLKKAFDMSSLQFSKILKTLNPDLLVYDFIQPWAPLL

ALSNKIPAVHFLCTSAAMSSFSVHAFKKPCEDFPFPNIYVHGNFMNAKFNNMENCSSDDSISDQ

DRVLQCFERSTKIILVKTFEELEGKFMDYLSVLLNKKIVPTGPLTQDPNEDEGDDDERTKLLLE

WLNKKSKSSTVFVSFGSEYFLSKEEREEIAYGLELSKVNFIWVIRFPLGENKTNLEEALPQGFL

QRVSERGLVVENWAPQAKILQHSSIGGFVSHCGWSSVMESLKFGVPIIAIPMHLDQPLNARLVV

DVGVGLEVIRNHGSLEREEIAKLIKEVVLGNGNDGEIVRRKAREMSNHIKKKGEKDMDELVEEL

MLICKMKPNSCHLS
```

Ziziphus jujube (SEQ ID NO: 138)
```
MMERQRSIKVLMFPWLAHGHISPFLELAKRLTDRNFQIYFCSTPVNLTSVKPKLSQKYSSSIKL

VELHLPSLPDLPPHYHTTNGLALNLIPTLKKAFDMSSSSFSTILSTIKPDLLIYDFLQPWAPQL

ASCMNIPAVNFLSAGASMVSFVLHSIKYNGDDHDDEFLTTELHLSDSMEAKFAEMTESSPDEHI

DRAVTCLERSNSLILIKSFRELEGKYLDYLSLSFAKKVVPIGPLVAQDTNPEDDSMDIINWLDK

KEKSSTVFVSFGSEYYLTNEEMEEIAYGLELSKVNFIWVVRFPLGQKMAVEEALPKGFLERVGE

KGMVVEDWAPQMKILGHSSIGGFVSHCGWSSLMESLKLGVPIIAMPMQLDQPINAKLVERSGVG

LEVKRDKNGRIEREYLAKVIREIVVEKARQDIEKKAREMSNIITEKGEEEIDNVVEELAKLCGM
```

Vitis vinifera (SEQ ID NO: 139)
```
MDARQSDGISVLMFPWLAHGHISPFLQLAKKLSKRNFSIYFCSTPVNLDPIKGKLSESYSLSIQ

LVKLHLPSLPELPPQYHTTNGLPPHLMPTLKMAFDMASPNFSNILKTLHPDLLIYDFLQPWAPA

AASSLNIPAVQFLSTGATLQSFLAHRHRKPGIEFPFQEIHLPDYEIGRLNRFLEPSAGRISDRD

RANQCLERSSRFSLIKTFREIEAKYLDYVSDLTKKKMVTVGPLLQDPEDEDEATDIVEWLNKKC

EASAVFVSFGSEYFVSKEEMEEIAHGLELSNVDFIWVVRFPMGEKIRLEDALPPGFLHRLGDRG

MVVEGWAPQRKILGHSSIGGFVSHCGWSSVMEGMKFGVPIIAMPMHLDQPINAKLVEAVGVGRE

VKRDENRKLEREEIAKVIKEVVGEKNGENVRRKARELSETLRKKGDEEIDVVVEELKQLCSY
```

Juglans regia (SEQ ID NO: 140)
```
MDTARKRIRVVMLPWLAHGHISPFLELSKKLAKRNFHIYFCSTPVNLSSIKPKLSGKYSRSIQL

VELHLPSLPELPPQYHTTKGLPPHLNATLKRAFDMAGPHFSNILKTLSPDLLIYDFLQPWAPAI

AASQNIPAINFLSTGAAMTSFVLHAMKKPGDEFPFPEIHLDECMKTRFVDLPEDHSPSDDHNHI

SDKDRALKCFERSSGFVMMKTFEELEGKYINFLSHLMQKKIVPVGPLVQNPVRGDHEKAKTLEW
```

-continued

LDKRKQSSAVFVSFGTEYFLSKEEMEEIAYGLELSNVNFIWVVRFPEGEKVKLEEALPEGFLQR

VGEKGMVVEGWAPQAKILMHPSIGGFVSHCGWSSVMESIDFGVPIVAIPMQLDQPVNAKVVEQA

GVGVEVKRDRDGKLEREEVATVIREVVMGNIGESVRKKEREMRDNIRKKGEEKMDGVAQELVQL

YGNGIKNV

Hevea brasiliensis
(SEQ ID NO: 141)
METLQRRKISVLMFPWLAHGHLSPFLELSKKLNKRNFHVYFCSTPVNLDSIKPKLSAEYSFSIQ

LVELHLPSSPELPLHYHTTNGLPPHLMKNLKNAFDMASSSFFNILKTLKPDLLIYDFIQPWAPA

LASSLNIPAVNFLCTSMAMSCFGLHLNNQEAKFPFPGIYPRDYMRMKVFGALESSSNDIKDGER

AGRCMDQSFHLILAKTFRELEGKYIDYLSVKLMKKIVPVGPLVQDPIFEDDEKIMDHHQVIKWL

EKKERLSTVFVSFGTEYFLSTEEMEEIAYGLELSKAHFIWVVRFPTGEKINLEESLPKRYLERV

QERGKIVEGWAPQQKILRHSSIGGFVSHCGWSSIMESMKFGVPIIAMPMNLDQPVNSRIVEDAG

VGIEVRRNKSGELEREEIAKTIRKVVVEKDGKNVSRKAREMSDTIRKKGEEEIDGVVDELLQLC

DVKTNYLQ

Manihot esculenta
(SEQ ID NO: 142)
MATAQTRKISVLMFPWLAHGHLSPFLELSKKLANRNFHVYFCSTPVNLDSIKPKLSPEYHFSIQ

FVELHLPSSPELPSHYHTTNGLPPHLMKTLKKAFDMASSSFFNILKTLNPDLLIYDFLQPWAPA

LASSLNIPAVNFLCSSMAMSCFGLNLNKNKEIKFLFPEIYPRDYMEMKLFRVFESSSNQIKDGE

RAGRCIDQSFHVILAKTFRELEGKYIDYVSVKCNKKIVPVGPLVEDTIHEDDEKTMDHHHHHHD

EVIKWLEKKERSTTVFVSFGSEYFLSKEEMEEIAHGLELSKVNFIWVVRFPKGEKINLEESLPE

GYLERIQERGKIVEGWAPQRKILGHSSIGGFVSHCGWSSIMESMKLGVPIIAMPMNLDQPINSR

IVEAAGVGIEVSRNQSGELEREEMAKTIRKVVVEREGVYVRRKAREMSDVLRKKGEEEIDGVVD

ELVQLCDMKTNYL

Cephalotus follicularis
(SEQ ID NO: 143)
MDLKRRSIRVLMLPWLAHGHISPFLELAKKLTNRNFLIYFCSTPINLNSIKPKLSSKYSFSIQL

VELHLPSLPELPPHYHTTNGLPLHLMNTLKTAFDMASPSFLNILKTLKPDLLICDHLQPWAPSL

ASSLNIPAIIFPTNSAIMMAFSLHHAKNPGEEFPFPSININDDMVKSINFLHSASNGLTDMDRV

LQCLERSSNTMLLKTFRQLEAKYVDYSSALLKKKIVLAGPLVQVPDNEDEKIEIIKWLDSRGQS

STVFVSFGSEYFLSKEEREDIAHGLELSKVNFIWVVRFPVGEKVKLEEALPNGFAERIGERGLV

VEGWAPQAMILSHSSIGGFVSHCGWSSMMESMKFGVPIIAMPMHIDQPLNARLVEDVGVGLEIK

RNKDGRFEREELARVIKEVLVYKNGDAVRSKAREMSEHIKKNGDQEIDGVADALVKLCEMKTNS

LNQD

Stevia rebaudiana UGT74G1
(SEQ ID NO: 144)
MAEQQKIKKSPHVLLIPFPLQGHINPFIQFGKRLISKGVKTTLVTTIHTLNSTLNHSNTTTTSI

EIQAISDGCDEGGFMSAGESYLETFKQVGSKSLADLIKKLQSEGTTIDAIIYDSMTEWVLDVAI

EFGIDGGSFFTQACVVNSLYYHVHKGLISLPLGETVSVPGFPVLQRWETPLILQNHEQIQSPWS

QMLFGQFANIDQARWVFTNSFYKLEEEVIEWTRKIWNLKVIGPTLPSMYLDKRLDDDKDNGFNL

YKANHHECMNWLDDKPKESVVYVAFGSLVKHGPEQVEEITRALIDSDVNFLWVIKHKEEGKLPE

NLSEVIKTGKGLIVAWCKQLDVLAHESVGCFVTHCGFNSTLEAISLGVPVVAMPQFSDQTTNAK

LLDEILGVGVRVKADENGIVRRGNLASCIKMIMEEERGVIIRKNAVKWKDLAKVAVHEGGSSDN

DIVEFVSELIKA

*Stevia rebaudiana* UGT76G1

(SEQ ID NO: 145)

MENKTETTVRRRRRIILFPVPFQGHINPILQLANVLYSKGFSITIFHTNFNKPKTSNYPHFTFR

FILDNDPQDERISNLPTHGPLAGMRIPIINEHGADELRRELELLMLASEEDEEVSCLITDALWY

FAQSVADSLNLRRLVLMTSSLFNFHAHVSLPQFDELGYLDPDDKTRLEEQASGFPMLKVKDIKS

AYSNWQILKEILGKMIKQTKASSGVIWNSFKELEESELETVIREIPAPSFLIPLPKHLTASSSS

LLDHDRTVFQWLDQQPPSSVLYVSFGSTSEVDEKDFLEIARGLVDSKQSFLWVVRPGFVKGSTW

VEPLPDGFLGERGRIVKWVPQQEVLAHGAIGAFWTHSGWNSTLESVCEGVPMIFSDFGLDQPLN

ARYMSDVLKVGVYLENGWERGEIANAIRRVMVDEEGEYIRQNARVLKQKADVSLMKGGSSYESL

ESLVSYISSL

*Stevia rebaudiana* UGT85C2

(SEQ ID NO: 146)

MDAMATTEKKPHVIFIPFPAQSHIKAMLKLAQLLHHKGLQITFVNTDFIHNQFLESSGPHCLDG

APGFRFETIPDGVSHSPEASIPIRESLLRSIETNFLDRFIDLVTKLPDPPTCIISDGFLSVFTI

DAAKKLGIPVMMYWTLAACGFMGFYHIHSLIEKGFAPLKDASYLTNGYLDTVIDWVPGMEGIRL

KDFPLDWSTDLNDKVLMFTTEAPQRSHKVSHHIFHTFDELEPSIIKTLSLRYNHIYTIGPLQLL

LDQIPEEKKQTGITSLHGYSLVKEEPECFQWLQSKEPNSVVYVNFGSTTVMSLEDMTEFGWGLA

NSNHYFLWIIRSNLVIGENAVLPPELEEHIKKRGFIASWCSQEKVLKHPSVGGFLTHCGWGSTI

ESLSAGVPMICWPYSWDQLTNCRYICKEWEVGLEMGTKVKRDEVKRLVQELMGEGGHKMRNKAK

DWKEKARIAIAPNGSSSLNIDKMVKEITVLARN

*Stevia rebaudiana* UGT91D1

(SEQ ID NO: 147)

MYNVTYHQNSKAMATSDSIVDDRKQLHVATFPWLAFGHILPFLQLSKLIAEKGHKVSFLSTTRN

IQRLSSHISPLINVVQLTLPRVQELPEDAEATTDVHPEDIQYLKKAVDGLQPEVTRFLEQHSPD

WIIYDFTHYWLPSIAASLGISRAYFCVITPWTIAYLAPSSDAMINDSDGRTTVEDLTTPPKWFP

FPTKVCWRKHDLARMEPYEAPGISDGYRMGMVFKGSDCLLFKCYHEFGTQWLPLLETLHQVPVV

PVGLLPPEIPGDEKDETWVSIKKWLDGKQKGSVVYVALGSEALVSQTEVVELALGLELSGLPFV

WAYRKPKGPAKSDSVELPDGFVERTRDRGLVWTSWAPQLRILSHESVCGFLTHCGSGSIVEGLM

FGHPLIMLPIFCDQPLNARLLEDKQVGIEIPRNEEDGCLTKESVARSLRSVVVENEGEIYKANA

RALSKIYNDTKVEKEYVSQFVDYLEKNARAVAIDHES

*Stevia rebaudiana* UGT91D2

(SEQ ID NO: 148)

MATSDSIVDDRKQLHVATFPWLAFGHILPYLQLSKLIAEKGHKVSFLSTTRNIQRLSSHISPLI

NVVQLTLPRVQELPEDAEATTDVHPEDIPYLKKASDGLQPEVTRFLEQHSPDWIIYDYTHYWLP

SIAASLGISRAHFSVTTPWAIAYMGPSADAMINGSDGRTTVEDLTTPPKWFPFPTKVCWRKHDL

ARLVPYKAPGISDGYRMGLVLKGSDCLLSKCYHEFGTQWLPLLETLHQVPVVPVGLLPPEVPGD

EKDETWVSIKKWLDGKQKGSVVYVALGSEVLVSQTEVVELALGLELSGLPFVWAYRKPKGPAKS

DSVELPDGFVERTRDRGLVWTSWAPQLRILSHESVCGFLTHCGSGSIVEGLMFGHPLIMLPIFG

DQPLNARLLEDKQVGIEIPRNEEDGCLTKESVARSLRSVVVEKEGEIYKANARELSKIYNDTKV

EKEYVSQFVDYLEKNTRAVAIDHES

*Stevia rebaudiana* UGT91D2e (SEQ ID NO: 149)

MATSDSIVDDRKQLHVATFPWLAFGHILPYLQLSKLIAEKGHKVSFLSTTRNIQRLSSHISPLI

NVVQLTLPRVQELPEDAEATTDVHPEDIPYLKKASDGLQPEVTRFLEQHSPDWIIYDYTHYWLP

SIAASLGISRAHFSVTTPWAIAYMGPSADAMINGSDGRTTVEDLTTPPKWFPFPTKVCWRKHDL

ARLVPYKAPGISDGYRMGLVLKGSDCLLSKCYHEFGTQWLPLLETLHQVPVVPVGLLPPEIPGD

-continued

EKDETWVSIKKWLDGKQKGSVVYVALGSEVLVSQTEVVELALGLELSGLPFVWAYRKPKGPAKS

DSVELPDGFVERTRDRGLVWTSWAPQLRILSHESVCGFLTHCGSGSIVEGLMFGHPLIMLPIFG

DQPLNARLLEDKQVGIEIPRNEEDGCLTKESVARSLRSVVVEKEGEIYKANARELSKIYNDTKV

EKEYVSQFVDYLEKNARAVAIDHES

OsUGT1-2
(SEQ ID NO: 150)
MDSGYSSSYAAAAGMHVVTCPWLAFGHLLPCLDLAQRLASRGHRVSFVSTPRNISRLPPVRPAL

APLVAFVALPLPRVEGLPDGAESTNDVPHDRPDMVELHRRAFDGLAAPFSEFLGTACADWVIVD

VFHHWAAAAALEHKVPCAMMLLGSAHMIASIADRRLERAETESPAAAGQGRPAAAPTFEVARMK

LIRTKGSSGMSLAERFSLTLSRSSLVVGRSCVEFEPETVPLLSTLRGKPITFLGLMPPLHEGRR

EDGEDATVRWLDAQPAKSVVYVALGSEVPLGVEKVHELALGLELAGTRFLWALRKPTGVSDADL

LPAGFEERTRGRGVVATRWVPQMSILAHAAVGAFLTHCGWNSTIEGLMFGHPLIMLPIFGDQGP

NARLIEAKNAGLQVARNDGDGSFDREGVAAAIRAVAVEEESSKVFQAKAKKLQEIVADMACHER

YIDGFIQQLRSYKD

*Arabidopsis thaliana* AAN72025.1
(SEQ ID NO: 151)
MGSISEMVFETCPSPNPIHVMLVSFQGQGHVNPLLRLGKLIASKGLLVTFVTTELWGKKMRQAN

KIVDGELKPVGSGSIRFEFFDEEWAEDDDRRADFSLYIAHLESVGIREVSKLVRRYEEANEPVS

CLINNPFIPWVCHVAEEFNIPCAVLWVQSCACFSAYYHYQDGSVSFPTETEPELDVKLPCVPVL

KNDEIPSFLHPSSRFTGFRQAILGQFKNLSKSFCVLIDSFDSLEREVIDYMSSLCPVKTVGPLF

KVARTVTSDVSGDICKSTDKCLEWLDSRPKSSVVYISFGTVAYLKQEQIEEIAHGVLKSGLSFL

WVIRPPPHDLKVETHVLPQELKESSAKGKGMIVDWCPQEQVLSHPSVACFVTHCGWNSTMESLS

SGVPVVCCPQWGDQVTDAVYLIDVFKTGVRLGRGATEERVVPREEVAEKLLEATVGEKAEELRK

NALKWKAEAEAAVAPGGSSDKNFREFVEKLGAGVTKTKDNGY

*Arabidopsis thaliana* AAF87256.1
(SEQ ID NO: 152)
MGSHVAQKQHVVCVPYPAQGHINPMMKVAKLLYAKGFHITFVNTVYNHNRLLRSRGPNAVDGLP

SFRFESIPDGLPETDVDVTQDIPTLCESTMKHCLAPFKELLRQINARDDVPPVSCIVSDGCMSF

TLDAAEELGVPEVLFWTTSACGFLAYLYYYRFIEKGLSPIKDESYLTKEHLDTKIDWIPSMKNL

RLKDIPSFIRTTNPDDIMLNFIIREADRAKRASAIILNTFDDLEHDVIQSMKSIVPPVYSIGPL

HLLEKQESGEYSEIGRTGSNLWREETECLDWLNTKARNSVVYVNFGSITVLSAKQLVEFAWGLA

ATGKEFLWVIRPDLVAGDEAMVPPEFLTATADRRMLASWCPQEKVLSHPAIGGFLTHCGWNSTL

ESLCGGVPMVCWPFFAEQQTNCKFSRDEWEVGIEIGGDVKREEVEAVVRELMDEEKGKNMREKA

EEWRRLANEATEHKHGSSKLNFEMLVNKVLLGE

*Columba livia* ClUGT1
(SEQ ID NO: 153)
MIHCGKKHICAFVTCILISASILMYSWKDPQLQNNITRKIFQATSALPASQLCRGKPAQNVITA

LEDNRTFIISPYFDDRESKVTRVIGIVHHEDVKQLYCWFCCQPDGKIYVARAKIDVHSDRFGFP

YGAADIVCLEPENCNPTHVSIHQSPHANIDQLPSFKIKNRKSETFSVDFTVCISAMFGNYNNVL

QFIQSVEMYKILGVQKVVIYKNNCSQLMEKVLKFYMEEGTVEIIPWPINSHLKVSTKWHFSMDA

KDIGYYGQITALNDCIYRNMQRSKFVVLNDADEIILPLKHLDWKAMMSSLQEQNPGAGIFLFEN

HIFPKTVSTPVFNISSWNRVPGVNILQHVHREPDRKEVFNPKKMIIDPRQVVQTSVHSVLRAYG

NSVNVPADVALVYHCRVPLQEELPRESLIRDTALWRYNSSLITNVNKVLHQTVL

*Haemophilus ducreyi* LgtF Q9L875

(SEQ ID NO: 154)

MPTLTVAMIVKNEAQDLAECLKTVDGWVDEIVIVDSGSTDDTLKIATQFNAKVYVNSDWQGFGP

QRQFAQQYVTSDYVLWLDADERVTPELKASILQAVQHNQKNTVYKVSRLSEIFGKEIRYSGWYP

DYVVRLYPTYLAKYGDELVHEKVHYPADSRVEKLQGDLLHFTYKNIHHYLVKSASYAKAWAMQR

AKAGKKASLLDGVTHAIACFLKMYLFKAGFLDGKQGFLLAVLSAHSTFVKYADLWDRTRS

*Neisseria gonorrhoeae* Q5F735

(SEQ ID NO: 155)

MKKVSVLIVAKNEANHIRECIESCRFDKEVIVIDDHSADNTAEIAEGLGAKVFRRHLNGDFGAQ

KTFAIEQAGGEWVFLIDADERCTPELSDEISKIVRTGDYAAYFVERRNLFPNHPATHGAMRPDS

VCRLMPKKGGSVQGKVHETVQTPYPERRLKHFMYHYTYDNWEQYFNKFNKYTSISAEKYREQGK

PVSFVRDIILRPIWGFFKIYILNKGFLDGKMGWIMSVNHSYYTMIKYVKLYYLYKSGGKF

*Rhizobium meliloti* (strain 1021) ExoM P33695

(SEQ ID NO: 156)

MPNETLHIDIGVCTYRRPELAETLRSLAAMNVPERARLRVIVADNDAEPSARALVEGLRPEMPF

DILYVHCPHSNISIARNCCLDNSTGDFLAFLDDDETVSGDWLTRLLETARTTGAAAVLGPVRAH

YGPTAPRWMRSGDFHSTLPVWAKGEIRTGYTCNALLRRDAASLLGRRFKLSLGKSGGEDTDFFT

GMHCAGGTIAFSPEAWVHEPVPENRASLAWLAKRRFRSGQTHGRLLAEKAHGLRQAWNIALAGA

KSGFCATAAVLCFPSAARRNRFALRAVLHAGVISGLLGLKEIEQYGAREVTSA

*Rhizobium radiobacter* Q44418

(SEQ ID NO: 157)

MCRCGRAVRSRPVCRPGQLVVRRSPRPRSRNHSRCRPLRLSVFPRPHRRVRHHCQRDLRWEPGR

WIAVRWKAARSHRRFRRCPFPRQLVWPVRERHRDAGDRRNQRERRRRDAYHEISEPKFRTRKRT

ESFWMNKAITVIVWLLVSLCVLAIITMPVSLQTHLVATAISLILLATIKSFNGQGAWRLVALGF

GTAIVLRYVYWRTTSTLPPVNQLENFIPGFLLYLAEMYSVVMLGLSLVIVSMPLPSRKTRPGSP

DYRPTVDVFVPSYNEDAELLANTLAAAKNMDYPADRFTVWLLDDGGSVQKRNAANIVEAQAAQR

RHEELKKLCEDLDVRYLTRERNVHAKAGNLNNGLAHSTGELVTVFDADHAPARDFLLETVGYFD

EDPRLFLVQTPHFFVNPDPIERNLRTFETMPSENEMFYGIIQRGLDKWNGAFFCGSAAVLRREA

LQDSDGFSGVSITEDCETALALHSRGWNSVYVDKPLIAGLQPATFASFIGQRSRWAQGMMQILI

FRQPLFKRGLSFTQRLCYMSSTLFWLFPFPRTIFLFAPLFYLFFDLQIFVASGGEFLAYTAAYM

LVNLMMQNYLYGSFRWPWISELYEYVQTVHLLPAVVSVIFNPGKPTFKVTAKDESIAEARLSEI

SRPFFVIFALLLVAMAFAVWRIYSEPYKADVTLVVGGWNLLNLIFAGCALGVVSERGDKSASRR

ITVKRRCEVQLGGSDTWVPASIDNVSVHGLLINIFDSATNIEKGATAIVKVKPHSEGVPETMPL

NVVRTVRGEGFVSIGCTFSPQRAVDHRLIADLIFANSEQWSEFQRVRRKKPGLIRGTAIFLAIA

LFQTQRGLYYLVRARRPAPKSAKPVGAVK

*Streptococcus agalactiae* cpsI O87183

(SEQ ID NO: 158)

MIKKIEKDLISVIVPIYNVEDYLVECIESLIVQTYRNIEILLINDGSTDNCATIAKEFSERDCR

VIYIEKSNGGLSEARNYGIYHSKGKYLTFVDSDDKVSSDYIANLYNAIQKHDSSIAIGGYLEFY

ERHNSIRNYEYLDKVIPVEEALLNMYDIKTYGSIFITAWGKLFHKSIFNDLEFALNKYHEDEFF

NYKAYLKANSITYIDKPLYHYRIRVGSIMNNSDNVIIARKKLDVLSALDERIKLITSLRKYSVF

LQKTEIFYVNQYFRTKKFLKQQSVMFKEDNYIDAYRMYGRLLRKVKLVDKLKLIKNRFF

*Streptococcus pneumoniae* cps3S Q54611

(SEQ ID NO: 159)

MYTFILMLLDFFQNHDFHFFMLFFVFILIRWAVIYFHAVRYKSYSCSVSDEKLFSSVIIPVVDE

PLNLFESVLNRISRHKPSEIIVVINGPKNERLVKLCHDFNEKLENNMTPIQCYYTPVPGKRNAI

-continued

RVGLEHVDSQSDITVLVDSDTVWTPRTLSELLKPFVCDKKIGGVTTRQKILDPERNLVTMFANL

LEEIRAEGTMKAMSVTGKVGCLPGRTIAFRNIVERVYTKFIEETFMGFHKEVSDDRSLTNLTLK

KGYKTVMQDTSVVYTDAPTSWKKFIRQQLRWAEGSQYNNLKMTPWMIRNAPLMFFIYFTDMILP

MLLISFGVNIFLLKILNITTIVYTASWWEIILYVLLGMIFSFGGRNFKAMSRMKWYYVFLIPVF

IIVLSIIMCPIRLLGLMRCSDDLGWGTRNLTE

MbUGTc13 (SEQ ID NO: 160)
MADAMATTEKKPHVIFIPFPAQSHIKAMLKLAQLLHHKGLQITFVNTDFIHNQFLESSGPHCLD

GAPGFRFETIPDGVSHSPEASIPIRESLLRSIETNFLDRFIDLVTKLPDPPTCIISDGFLSVFT

IDAAKKLGIPVMMYWTLAACGFMGFYHIHSLIEKGFAPLKDASYLTNGYLDTVIDWVPGMEGIR

LKDFPLDWSTDLNDKVLMFTTEATQRSHKVSHHIFHTFDELEPSIIKTLSLRYNHIYTIGPLQL

LLDQIPEEKKQTGITSLHGYSLVKEEPECFQWLQSKEPNSVVYVNFGSTTVMSLEDMTEFGWGL

ANSNHYFLWIIRSNLVIGENAVLPPELEEHIKKRGFIASWCSQEKVLKHPSVGGFLTHCGWGST

IESLSAGVPMICWPYSWDQLTNCRYICKEWEVGLEMGTKVKRDEVKRLVQELMGEGGHKMRNKA

KDWKEKARIAIAPNGSSSLNIDKMVKEITVLARN

MbUGTc19 (SEQ ID NO: 161)
MANHHECMNWLDDKPKESVVYVAFGSLVKHGPEQVEEITRALIDSDVNFLWVIKHKEEGKLPEN

LSEVIKTGKGLIVAWCKQLDVLAHESVGCFVTHCGFNSTLEAISLGVPVVAMPQFSDQTTNAKL

LDEILGVGVRVKADENGIVRRGNLASCIKMIMEEERGVIIRKNAVKWKDLAKVAVHEGGSSDND

IVEFVSELIKAGSGEQQKIKKSPHVLLIPFPLQGHINPFIQFGKRLISKGVKTTLVTTIHTLNS

TLNHSNTTTTSIEIQAISDGCDEGGFMSAGESYLETFKQVGSKSLADLIKKLQSEGTTIDAIIY

DSMTEWVLDVAIEFGIDGGSFFTQACVVNSLYYHVHKGLISLPLGETVSVPGFPVLQRWETPLI

LQNHEQIQSPWSQMLFGQFANIDQARWVFTNSFYKLEEEVIEWTRKIWNLKVIGPTLPSMYLDK

RLDDDKDNGFNLYKA

MbUGT1-3 (SEQ ID NO: 162)
MENKTETTVRRRRRIILFPVPFQGHINPILQLANVLYSKGFSITIFHTNFNKPKTSNYPHFTFR

FILDNDPQDERISNLPTHGPLAGMRIPIINEHGADELRRELELLMLASEEDEEVSCLITDALWY

FAQSVADSLNLRRLVLMTSSLFNFHAHVSLPQFDELGYLDPDDKTRLEEQASGFPMLKVKDIKS

AYSNWQILKEILGKMIKQTKASSGVIWNSFKELEESELETVIREIPAPSFLIPLPKHLTASSSS

LLDHDRTVFQWLDQQPPSSVLYVSFGSTSEVDEKDFLEIARGLVDSKQSFLWVVRPGFVKGSTW

VEPLPDGFLGERGRIVKWVPQQEVLAHGAIGAFWTHSGWNSTLESVCEGVPMIFSDFGLDQPLN

ARYMSDVLKVGVYLENGWERGEIANAIRRVMVDEEGEYIRQNARVLKQKADVSLMKGGSSYESL

ESLVSYISSL

MbUGT1-2 (SEQ ID NO: 163)
MATKGSSGMSLAERFWLTLSRSSLVVGRSCVEFEPETVPLLSTLRGKPITFLGLMPPLHEGRRE

DGEDATVRWLDAQPAKSVVYVALGSEVPLGVEKVHELALGLELAGTRFLWALRKPTGVSDADLL

PAGFEERTRGRGVVATRWVPQMSILAHAAVGAFLTHCGWNSTIEGLMFGHPLIMLPIFGDQGPN

ARLIEAKNAGLQVARNDGDGSFDREGVAAAIRAVAVEEESSKVFQAKAKKLQEIVADMACHERY

IDGFIQQLRSYKDDSGYSSSYAAAAGMHVVICPWLAFGHLLPCLDLAQRLASRGHRVSFVSTPR

NISRLPPVRPALAPLVAFVALPLPRVEGLPDGAESTNDVPHDRPDMVELHRRAFDGLAAPFSEF

LGTACADWVIVDVFHHWAAAAALEHKVPCAMMLLGSAEMIASIADERLEHAETESPAAAGQGRP

AAAPTFEVARMKLIR

-continued

Coffea arabica
(SEQ ID NO: 164)
MENHATFNVLMLPWLAHGHVSPYLELAKKLTARNFNVYLCSSPATLSSVRSKLTEKFSQSIHLV

ELHLPKLPELPAEYHTTNGLPPHLMPTLKDAFDMAKPNFCNVLKSLKPDLLIYDLLQPWAPEAA

SAFNIPAVVFISSSATMTSFGLHFFKNPGTKYPYGNAIFYRDYESVFVENLTRRDRDTYRVINC

MERSSKIILIKGFNEIEGKYFDYFSCLTGKKVVPVGPLVQDPVLDDEDCRIMQWLNKKEKGSTV

FVSFGSEYFLSKKDMEEIAHGLEVSNVDFIWVVRFPKGENIVIEETLPKGFFERVGERGLVVNG

WAPQAKILTHPNVGGFVSHCGWNSVMESMKFGLPIIAMPMHLDQPINARLIEEVGAGVEVLRDS

KGKLHRERMAETINKVMKEASGESVRKKARELQEKLELKGDEEIDDVVKELVQLCATKNKRNGL

HYY

Stevia rebaudiana UGT85C1
(SEQ ID NO: 165)
MDQMAKIDEKKPHVVFIPFPAQSHIKCMLKLARILHQKGLYITFINTDTNHERLVASGGTQWLE

NAPGFWFKTVPDGFGSAKDDGVKPTDALRELMDYLKTNFFDLFLDLVLKLEVPATCIICDGCMT

FANTIRAAEKLNIPVILFWTMAACGFMAFYQAKVLKEKEIVPVKDETYLTNGYLDMEIDWIPGM

KRIRLRDLPEFILATKQNYFAFEFLFETAQLADKVSHMIIHTFEELEASLVSEIKSIFPNVYTI

GPLQLLLNKITQKETNNDSYSLWKEEPECVEWLNSKEPNSVVYVNFGSLAVMSLQDLVEFGWGL

VNSNHYFLWIIRANLIDGKPAVMPQELKEAMNEKGFVGSWCSQEEVLNHPAVGGFLTHCGWGSI

IESLSAGVPMLGWPSIGDQRANCRQMCKEWEVGMEIGKNVKRDEVEKLVRMLMEGLEGERMRKK

ALEWKKSATLATCCNGSSSLDVEKLANEIKKLSRN

SEQUENCE LISTING (170 sequences)

SEQ ID NO: 1 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 2 - protein, 417 aa, Siraitia grosvenorii
MGSLGAILRHPDDFYPLLKLKMAARHAEKQIPPEPHWGFCYTMLHKVSRSFALVIQQLAPELRNAICIFYLVLRALDTVEDDTSIQTDIKVPILKAFHCHIYNRDWHFSCGTKDYKVLMDQFHHVSTAFLELGKGYQEAIEDITKRMGAGMAKFICKEVETVDDYDEYCHYVAGLVGLGLSKLFHASDLEDLAPDSLSNSMGLLLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTQTMADVYGAFFDFSVMLKAKVNSSDPNATKTLSRIEAIQKTCEQSGLLNKRKLYAVKSEPMFNPTLIVILFSLLCIILAYLSAKRLPANQPV

SEQ ID NO: 3 - protein, 417 aa, Siraitia grosvenorii
MGSLGAILRHPDDFYPLLKLKMAARHAEKQIPPEPHWGFCYTMLHKVSRSFALVIQQLAPELRNAICIFYLVLRALDTVEDDTSIQTDIKVPILKAFHCHIYNRDWHFSCGTKDYKVLMDQFHHVSTAFLELGKGYQEAIEDITKRMGAGMAKFICKEVETVDDYDEYCHYVAGLVGLGLSKLFHASDLEDLAPDSLSNSMGLLLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTQTMADVYGAFFDFSVMLKAKVNNSDPNATKTLSRIEAIQKTCEQSGLLNKRKLYAVKSEPMFNPTLIVILFSLLCIILAYLSAKRLPANQPV

SEQ ID NO: 4 - protein, 417 aa, Cucumis sativus
MGSLGAILKHPDDFYPLLKLKIAARHAEKQIPPEPHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGKGYQEAIEDITKRMGAGMAKFICKEVETVDDYDEYCHYVAGLVGLGLSKLFHAAELEDLAPDSLSNSMGLFLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTKTMADVYGAFFDFSVMLKAKVNSNDPNASKTLSRIEAIQKTCKQSGILNRRKLYVVRSEPMFNPAVIVILFSLLCIILAYLSAKRLPANQSV

SEQ ID NO: 5 - protein, 417 aa, Cucumis melo
MGSLGAILKHPDDFYPLLKLKMAARHAEKQIPPESHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGKGYQEAIEDITKRMGAGMAKFICKEVETVDDYDEYCHYVAGLVGLGLSKLFHAAELEDLAPDSLSNSMGLFLQKTNIIRDYLEDINEIPKSRMFWPREIWGKYADKLEDFKYEENSVKAVQCLNDLVTNALNHVEDCLKYMSNLRDLSIFRFCAIPQIMAIGTLALCYNNVEVFRGVVKMRRGLTAKVIDRTKTMADVYGAFFDFSVMLKAKVNSNDPNASKTLSRIEAIQQTCQQSGLMNKRKLYVVRSEPMYNPAVIVILFSLLCIILAYLSAKRLPANQSV

SEQ ID NO: 6 - protein, 417 aa, Cucumis melo
MGSLGAILKHPDDFYPLLKLKMAARHAEKQIPPESHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGKGYQEAIEDITKRMGAGMAKFICKEVETVDDYDEYCHYVAGLVGLGLSKLFHAAELEDLAPDSLSNSMGLFLQKTNIIRDYLEDINEIPKSRMFWPREIWGKYADKLEDFKYEENSVKAVQCLNDLVTNALNHVEDCPKYMSNLRDLSIFRFCAIPQIMAIGTLALCYNNVEVFRGVVKMRRGLTAKVIDRTKTMADVYGAFFDFSVMLKAKVNSNDPNASKTLSRIEAIQQTCQQSGLMNKRKLYVVRSEPMYNPAVIVILFSLLCIILAYLSAKRLPANQSV

SEQ ID NO: 7 - protein, 417 aa, Cucurbita moschata
MGSLGAILRHPDDIYPLLKLKMAARHAEKQIPPESHWGFCYTMLHKVSRSFALVIQQLKPELRNAVCIFYLVLRALDTVEDDTSIQTDIKVPILKAFHCHIYNRDWHFSCGTKDYKVLMDEFHHVSTAFLELGRGYQEAIEDITKRMGAGMAKFICKEVETVEDYDEYCHYVAGLVGLGLSKLFHASKSENLAPDSLSNSMGLFLQKTNIIRDYLEDINEIPKSRMFWPREIWSKYADKLEDFKYEKNSVKAVQCLNDLVTNALTHVEDCLEYMSNLKDLSIFRFCAIPQIMAIGTLALCYNNVDVFRGVVKMRRGLTAKVIYRTKTMADVYGAFFDFSVMLKAKVNSSDPNASKTLTRIEAIQKTCKQSGLLNKRELYAVRSEPMCNPAAIVVLFSLLCIILAYLSAKLLPANQPV

SEQ ID NO: 8 - protein, 417 aa, Sechium edule
MGSLGAILSHPDDLYPLLKLKMAAKHAEKQIPPDPHWGFCFSMLHKVSRSFALVIQQLKPELRNAVCIFYLVLRALDTVEDDTGIHPDIKVPILQAFHCHIYNRDWHFSCGTKHYKVLMDEFHHVSTAFLELGKGYQEAIEDVTERMGAGMAKFICKEVETVDDYDEYCHYVAGLVGLGLSKLFHAAELEDLAPDSLSNSMGLFLQKTNIIRDYLEDINEIPKSRMFWPREIWNKYADKLEDFKYEENSVKAVQCLNDLVTNALNHVEDCLKYMSNLKDLSTFRFCAIPQIMAIGTLALCYDNVEVFRGVVKMRRGLTAKIIDRTKKIADVYGAFFDFSVMLKAKVNSSDPNAAKTLSRIEAIEKTCKESGLLNKRKLYVIRSEPLFNPAVLVILFSLICILLAYLSAKRLPANQPV

SEQ ID NO: 9 - protein, 415 aa, Panax quinquefolius
MGSLGAILKHPDDFYPLLKLKFAARHAEKQIPPEPHWAFCYSMLHKVSRSFGLVIQQLGPQLRDAVCIFYLVLRALDTVEDDTSIPTEVKVPILMAFHRHIYDKDWHFSCGTKEYKVLMDEFHHVSNAFLELGSGYQEAIEDITMRMGAGMAKFICKEVETIDDYDEYCHYVAGLVGLGLSKLFHASGAEDLATDSLSNSMGLFLQKTNIIRDYLEDINEIPKSRMFWPRQIWSKYVDKLEDLKYEENSAKAVQCLNDMVTDALVHAEDCLKYMSDLRDPAIFRFCAIPQIMAIGTLALCFNNTQVFRGVVKMRRGLTAKVIDRTKTMSDVYGAFFDFSCLLKSKVDNNDPNATKTLSRLEAIQKTCKESGTLSKRKSYIIESESGHNSALIAIIFIILAILYAYLSSNLLLNKQ

SEQ ID NO: 10 - protein, 412 aa, Malus domestica
MGALSTMLKHPDDIYPLLKLKIASRQIEKQIPAEPHWAFCYTMLQKVSRSFALVIQQLGTELRNAVCLFYLVLRALDTVEDDTSVATDVKVPILLAFHRHIYDPDWHFACGTNNYKVLMDEFHHVSTAFLELGTGYQEAIEDITKRMGAGMAKFILKEVETIDDYDEYCHYVAGLVGLGLSKLFHAAGKEDLASDSLSNSMGLFLQKTNIIRDYLEDINEIPKSRMFWPRQIWSKYVNKLEDLKYEENSEKAVQCLNDMVTNALIHMEDCLKYMAALRDPAIFKFCAIPQIMAIGTLALCYNNIEVFRGVVKMRRGLTAKVIDRTKSMDDVYGAFFDFSSILKSKVDKNDPNATKTLSRVEAVQKLCRDSGALSKRKSYIANREQSYNSTLIVALFIILAIIYAYLSASPRI

SEQ ID NO: 11 - protein, 354 aa, Artemisia annua
AVCIFYLVLRALDTVEDDTSIAADIKVPILIAFHKHIYNRDWHFACGTKEYKVLMDQFHHVSTAFLELKRGYQEAIEDITMRMGAGMAKFICKEVETVDDYDEYCHYVAGLVGIGLSKLFHSSGTEILFSDSISNSMGLFLQKTNIIRDYLEDINEIPKSRMFWPREIWSKYVNKLEDLKYEENSEKAVQCLNDMVTNALIHIEDCLKYMSQLKDPAIFRFCAIPQIMAIGTLALCYNNIEVFRGVVKLRRGLTAKVIDRTKTMADVYQAFSDFSDMLKSKVDMHDPNAQTTITRLEAAQKICKDSGTLSNRKSYIVKRESSYSAALLALLFTILAILYAYLSANRPNKIKFTL

SEQ ID NO: 12 - protein, 408 aa, Glycine soja
MDQRSEDEFYPLLKLKIVARNAEKQIPPEPHWAFCYTMLHKVSRSFALVIQQLGIELRNAVCIFYLVLRALDTVEDDTSIETDVKVPILIAFHRHIYDRDWHFSCGTKEYKVLMGQFHHVSTAFLELGKNYQEAIEDITKRMGAGMAKFICKEVETIDDYDEYCHYVAGLVGLGLSKLFHASGSEDLAPDDLSNSMGLFLQKTNIIRDYLEDINEIPKSRMFWPRQIWSEYVNKLEDLKYEENSVKAVQCLNDMVTNALMHAEDCLTYMAALRDPPIFRFCAIPQIMAIGTLALCYNNIEVFRGVVKMRRGLTAKVIDRTKTMADVYGAFFDFASMLEPKVDKNDPNATKTLSRLEAIQKTCRESGLLSKRKSYIVNDESGYGSTMIVILVIMVSIIFAYLSANHHNS

SEQ ID NO: 13 - protein, 415 aa, Diospyros kaki
MGSLAAMLRHPDDVYPLVKLKMAARHAEKQIPPEPHWAFCYTMLHKVSRSFGLVIQQLGTELRNAVCIFYLVLRALDTVEDDTSIATEVKVPILLAFHHHIYDRDWHFSCGTREYKVLMDEFHHVSTAFLELGKGYQEAIEDITMRMGAGMAKFICKEVETIDDYDEYCHYVAGLVGLGLSKLFHASGLEDLAPDSLSNSMGLFLQKTNIIRDYLEDINEIPKSRMFWPRQIWSKYVNKLEDLKYEKNSVKSVQCLNDMVTNALIHVDDCLKYMSALRDPAIFRFCAIPQIMAIGTLALCYNNIEVFRGVVKMRRGLTAKVIDQTKTISDVYGAFFDFSCMLKSKVEKNDPNSTKTLSRIEAIQKTCRESGTLSKRKSYILRSKRTHNSTLIFVLFIILAILFAYLSANRPPINM

SEQ ID NO: 14 - protein, 410 aa, Euphorbia lathyris
MGSLGAILKHPDDFYPLLKLKMAAKHAEKQIPAQPHWGFCYSMLHKVSRSFSLVIQQLGTELRDAVCIFYLVLRALDTVEDDTSIPTDVKVPILIAFHKHIYDPEWHFSCGTKEYKVLMDQIHHLSTAFLELGKSYQEAIEDITKKMGAGMAKFICKEVETVDDYDEYCHYVAGLVGLGLSKLFDASGFEDLAPDDLSNSMGLFLQKTNIIRDYLEDINEIPKSRMFWPRQIWSKYVNKLEDLKYEENSVKAVQCLNDMVTNALIHMDDCLKYMSALRDPAIFRFCAIPQIMAIGTLALCYNNVEVFRGVVKMRRGLTAKVIDRTRTMADVYRAFFDFSCMMKSKVDRNDPNAEKTLNRLEAVQKTCKESGLLNKRRSYINESKPYNSTMVILLMIVLAIILAYLSKRAN

SEQ ID NO: 15 - protein, 413 aa, Camellia oleifera
MGSLGAILKHPDDFYPLMKLKMAARRAEKNIPPEPHWGFCYSMLHKVSRSFALVIQQLDTELRNAVCIFYLVLRALDTVEDDTSIATEVKVPILMAFHRHIYDRDWHFSCGTKEYKVLMDEFHHVSTAFSELGRGYQEAIEDITMRMGAGMAKFICKEVETIDDYDEYCHYVAGLVGLGLSKLFHASGSEDLASDSLSNSMGLFLQVFLLTCIKTNIIRDYLEDINEIPKSRMFWPRQIWSKYVNKLEDLKDKENSVKAVECLNDMVTNALIHVEDCLTYMSALRDPSIFRFCAIPQIMAIGTLALCYNNIEVFRGVVKMRRGLTAKVIDRTKTMSDVYGGFFDFSCMLKSKVNKSDPNAMKALSRLEAIQKICRESGTLNKRKSYIIKSEPRYNSTLVFVLFIILAILFAYL

SEQ ID NO: 16 - protein, 414 aa, Eleutherococcus senticosus
MGSLGAILKHPDDFYPLLKLKFAARHAEKQIPPEPHWAFCYSMLHKVSRSFGLVIQQLDAQLRDAVCIFYLVLRALDTVEDDTSIPTEVKVPILMAFHRHIYDKDWHFSCGTKEYKVLMDEFHHVSNAFLELGSGFQEAIEDITMRMGAGMAKFICKEVETIDDYDEYCHYVAGLVGLGLSKLFHASGAEDLATDSLSNSMGLFLQKTNIIRDYLEDINEIPKSRMFWPRQIWSKYVDKLENLKYEENSAKAVQCLNDMVTNALLHAEDCLKYMSNLRDPAIFRFCAIPQIMAIGTLALCFNNIQVFRGVVKMRRGLTAKVIDRTKTMSDVYGAFFDFSCLLKSKVDNNDPNATKTLSRLEAIQKTCKESGTLSKRKSYIIESKSAHNSALIAIIFIILAILYAYLSSNLPNNQ

SEQ ID NO: 17 - protein, 528 aa, Siraitia grosvenorii
MVDQCALGWILASALGLVIALCFFVAPRRNHRGVDSKERDECVQSAATTKGECRFNDRDVDVIVVGAGVAGSALAHTLGKDGRRVHVIERDLTEPDRIVGELLQPGGYLKLIELGLQDCVEEIDAQRVYGYALFKDGKNTRLSYPLENFHSDVSGRSFHNGRFIQRMREKAASLPNVRLEQGTVTSLLEEKGTIKGVQYKSKNGEEKTAYAPLTIVCDGCFSNLRRSLCNPMVDVPSYFVGLVLENCELPFANHGHVILGDPSPILFYQISRTEIRCLVDVPGQKVPSIANGEMEKYLKTVVAPQVPPQIYDSFIAAIDKGNIRTMPNRSMPAAPHPTPGALLMGDAFNMRHPLTGGGMTVALSDIVVLRNLLKPLKDLSDASTLCKYLESFYTLRKPVASTINTLAGALYKVFCASPDQARKEMRQACFDYLSLGGIFSNGPVSLLSGLNPRPLSLVLHFFAVAIYGVGRLLLPFPSVKGIWIGARLIYSASGIIFPIIRAEGVRQMFFPATVPAYYRSPPVFKPIV

SEQ ID NO: 18 - protein, 524 aa, Siraitia grosvenorii
MVDQCALGWILASVLGAAALYFLFGRKNGGVSNERRHESIKNIATTNGEYKSSNSDGDIIIVGAGVAGSALAYTLGKDGRRVHVIERDLTEPDRIVGELLQPGGYLKLTELGLEDCVDDIDAQRVYGYALFKDGKDTRLSYPLEKFHSDVAGRSFHNGRFIQRMREKAASLPKVSLEQGTVTSLLEENGIIKGVQYKTKTGQEMTAYAPLTIVCDGCFSNLRRSLCNPKVDVPSCFVGLVLENCDLPYANHGHVILADPSPILFYRISSTEIRCLVDVPGQKVPSISNGEMANYLKNVVAPQIPSQLYDSFVAAIDKGNIRTMPNRSMPADPYPTPGALLMGDAFNMRHPLTGGGMTVALSDVVVLRDLLKPLRDLNDAPTLSKYLEAFYTLRKPVASTINTLAGALYKVFCASPDQARKEMRQACFDYLSLGGIFSNGPVSLLSGLNPRPISLVLHFFAVAIYGVGRLLIPFPSPKRVWIGARIISGASAIIFPIIKAEGVRQMFFPATVAAYYRAPRVVKGR

SEQ ID NO: 19 - protein, 526 aa, Momordica charantia
MVDECALGWILAAALGAVIALCLFVAPKTNNQDGGVDSKATPECVQTTNGECRSDGDSDVIIVGAGVAGSALAHTLGKDGRRVHVIERDLTEPDRIVGELLQPGGYLKLIELGLADCVEEIDAQRVYGYALFKDGKNTRLSYPLEKFHSDVSGRSFHNGRFIQRMREKADSLPNVRLEQGTVTSLLEEKGTIKGVQYKSKDGKEKTAYAPLTIVCDGCFSNLRRSLCNPMVDVPSCFVGLVLENCQLPFANHGHVVLGDPSPILFYPISSTEIRCLVDVPGQKVPSISNGEMEKYLKTVVAPQVPPQIYDAFIAAIDKGNIRTMPNRSMPAAPHPTPGALLMGDAFNMRHPLTGGGMTVALSDIVVLRNLLKPLKDLHDAPTLCKYLESFYTLRKPVASTINTLAGALYKVFCASPDQARKEMRQACFDYLSLGGMFSNGPVSLLSGLNPRPLSLVLHFFAVAIYGVGRLLFPFPSPKGIWIGARLIYSASGIIFPIIKAEGVRQMFFPATVPAYYRSPPALKPVA

SEQ ID NO: 20 - protein, 529 aa, Cucurbita maxima
MVDYCAFGWILAAVLGLAIALSFFVSPRRNRRGGADSTPRSEGVRSSSTTNGECRSVDGDADVIIVGAGVAGSALAHTLGKDGRLVHVIERDLTEPDRIVGELLQPGGYLKLIELGLQDCVEEIDAQKVYGYALFKDGKNTQLSYPLEKFQSDVSGRSFHNGRFIQRMREKAASLPNVRLEQGTVTSLLEEKGTIKGVQYKSKNGEEKTAYAPLTIVCDGCFSNLRRSLCKPMVDVPSCFVGLVLENCQLPFANHGHVVLGDPSPILFYPISSTEIRCLVDVPGQKIPSISNGEMEKYLKTIVAPQVPPQIHDAFIAAIDKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASPDQARKEMRQACFDYLSLGGIFSNGPVSLLSGLNPRPLSLVLHFFAVAIYGVGRLLLPFPSPKGIWIGARLVYSASGIIFPIIKAEGVRQMFFPATVPAYYRSPPVHKSIA

SEQ ID NO: 21 - protein, 529 aa, Cucurbita moschata
MVDYCAFGWILAAVLGLAIALSFFVSPRRNRRGGADSTPRSEGVRSSSTTNGECRSVDCDADVIIVGAGVAGSALAHTLGKDGRLVHVIERDLTEPDRIVGELLQPGGYLKLIELGLQDCVEEIDAQKVYGYALFKDGKNTQLSYPLEKFQSDVSGRSFHNGRFIQRMREKAASLPNVRLEQGTVTSLLEEKGTIKGVQYKSKNGEEKTAHAPLTIVCDGCFSNLRRSLCKPMVDVPSCFVGLVLENCQLPFANHGHVVLGDPSPILFYPISSTEIRCLVDVPGQKVPSISNGEMEKYLKTIVAPQVPPQIHDAFIAAIDKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASPDQARKEMRQACFDYLSLGGIFSNGPVSLLSGLNPRPLSLVLHFFAVAIYGVGRLLLPFPSPKGIWIGARLVYSASGIIFPIIKAEGVRQMFFPATVPAYYRSPPVLKTIA

SEQ ID NO: 22 - protein, 531 aa, Cucurbita moschata
MMVDHCAFAWILDVVLGLVVAVTFFVAAPRRNRRGGTDSTASKDCVISTAIANGECKPDDADAEVIIVGAGVAGSALAYTLGKDGRRVHVIERDLTEPDRIVGEFLQPGGYLKLIELGLGDCVEEIDAQKLYGYALFKDGKNTRVSYPLGNFHSDVSGRSFHNGRFIQRMREKAASLPNVRLEQGTVTSLLETKGTIKGVQYKSKNGEEKTAYAPLTIVCDGCFSNLRRSLCKPMVDVPSCFVGLVLENCQLPFANHGHVVLGDPSPILFYPISSTEIRCLVDVPGQKVPSISNGDMEKYLKTVVAPQVPPQIHDAFIAAIEKGNVRTMPNRSMPAAPHPTPGALLMGDAFNMRHPLTGGGMTVALSDIVVLRNLLKPLKDLNDASTLCKYLESFYTLRKPVASTINTLAGALYKVFCASPDQARKEMRQACFDYLSLGGVFSNGPISLLSGLNPRPSSLVLHFFAVAIYGVGRLLLPFPSLKGIWIGARLIYSASGIILPIIKAEGVRQMFFPATVPAYYRSPPVHKPIT

SEQ ID NO: 23 - protein, 528 aa, Cucumis sativus
MVDHCTFGWIFSAFLAFVIAFSFFLSPRKNRRGRGTNSTPRRDCLSSSATTNGECRSVDGDADVIIVGAGVAGSALAHTLGKDGRRVHVIERDLTEPDRIVGELLQPGGYLKLIELGLQDCVEEIDAQKVYGYALFKDGKSTRLSYPLENFQSDVSGRSFHNGRFIQRMREKAAFLPNVRLEQGTVTSLLEEKGTITGVQYKSKNGEQKTAYAPLTIVCDGCFSNLRRSLCNPMVDVPSCFVGLVLENCQLPYANLGHVVLGDPSPILFYPISSTEIRCLVDVPGQKVPSISNGEMEKYLKTVVAPQVPPQIHDAFIAAIEKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASSDQARKEMRQACFDYLSLGGIFSNGPVSLLSGLNPRPLSLVLHFFAVAIYGVGRLLLPFPSPKGIWIGARLVYSASGIIFPIIKAEGVRQMFFPATVPAYYRTPPVFNS

SEQ ID NO: 24 - protein, 528 aa, Cucumis melo
MVDHCAFGWIFSALLAFPIALSLFLSPWRNRRVRGTDSTPRSASVSSSATTNGECRSVDGDADVVIVGAGVAGSALAHTLGKDGRRVHVIERDLTEPDRIVGELLQPGGYLKLIELGLQDCVEEIDAQKVYGYALFKDGKNTRLSYPLENFHSDVSGRSFHNGRFIQRMREKAASLPNVRLEQGTVTSLLEEKGTITGVQYKSKNGEQKTAYAPLTIVCDGCFSNLRRSLCTPMVDVPSYFVGLVLENCQLPYANLGHVVLGDPSPILFYPISSTEIRCLVDVPGQKVPSISNGEMEKYLKTVVAPQVPPQIHDAFIAAIEKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASPDQARKEMRQACFDYLSLGGIFSNGPVSLLSGLNPRPLSLVLHFFAVAIYGVGRLLLPFPSLKGIWIGARLVYSASGIIFPIIKAEGVRQMFFPATVPAYYRTPPVLNS

SEQ ID NO: 25 - protein, 533 aa, Cucurbita maxima
MMVEHCAYGWILAAVLGLVVAVTFFVAVPRRNRRGGTDSTASKDCVISPAIANGECEPEDADADADVIIVGAGVAGSALAHTLGKDGRRVHVIERDLTEPDRIVGEFLQPGGHLKLIELGLGDCVEEIDAQKLYGYALFKDGKNTRVSYPLGNFHSDVSGRSFHNGRFIQRMREKAASLPNVRLEQGTVTSLLEKKGTIKGVQYKSKNGEEKTAYAPLTIVCDGCFSNLRRSLCKPMVDVPSCFVGLVLENCRLPFANHGHVVLGDPSPILFYPISSTEIRCLVDVPGQKVPSIPNGDMEKYLKTVVAPQVPPQIHDAFIAAIEKGNIRTMPNRSMPAAPHPTPGALLMGDAFNMRHPLTGGGMTVALSDIVVLRNLLKPLKDLNDAPTLCKYLESYYTLRKPVASTINTLAGALYKVFCASPDQARKEMRQACFDYLSLGGVFSNGPISLLSGLNPRPSCLVLHFFAVAIYGVGRLLLPFPSLKGIWIGARLIYSASGIILPIIKAEGVRQMFFPATVPAYYRSPPVHKPIT

SEQ ID NO: 26 - protein, 522 aa, Ziziphus jujube
MLDQCPLGWILASVLGLFVLCNLIVKNRNSKASLEKRSECVKSIATTNGECRSKSDDVDVIIVGAGVAGSALAHTLGKDGRRLHVIERDLTEPDRIVGELLQPGGYLKLIELGLQDCVEEIDAQRVFGYALFKDGKDTRLSYPLEKFHSDVSGRSFHNGRFIQRMREKSASLPNVRLEQGTVTSLLEEKGTIKGVQYKTKTGQELTAFAPLTIVCDGCFSNLRRSLCNPKVDVPSCFVGLVLENCELPYANHGHVILADPSPILFYPISSTEVRCLVDVPGQKVPSISNGEMAKYLKSVVAPQIPPQIYDAFIAAVDKGNIRTMPNRSMPASPFPTPGALLMGDAFNMRHPLTGGGMTVALSDIVVLRDLLKPLGDLNDAATLCKYLESFYTLRKPVASTINTLAGALYKVFCASPDQARKEMRQACFDYLSLGGIFSTGPVSLLSGLNPRPLSLVLHFFAVAIYGVGRLLLPFPSPKRIWIGARLISGASGIIFPIIKAEGVRQMFFPATVPAYYRAAPVE

SEQ ID NO: 27 - protein, 524 aa, Morus alba
MADPYTMGWILASLLGLFALYYLFVNNKNHREASLQESGSECVKSVAPVKGECRSKNGDADVIIVGAGVAGSALAHTLGKDGRRVHVIERDLAEPDRIVGELLQPGGYLKLIELGLQDCVEEIDSQRVYGYALFKDGKDTRLSYPLEKFHSDVSGRSFHNGRFIQRMREKAASLPNVQLEQGTVTSLLEENGTIKGVQYKTKTGQELTAYAPLTIVCDGCFSNLRRSLCIPKVDVPSCFVGLVLENCNLPYANHGHVVLADPSPILFYPISSTEVRCLVDVPGQKVPSISNGEMAKYLKTVVASQIPPQIYDSFVAAVDKGNIRTMPNRSMPAAPHPTPGALLMGDAFNMRHPLTGGGMTVALSDIVVLRDLLKPLRDLNDSVTLCKYLESFYTLRKPVASTINTLAGALYKVFCASPDQARKEMREACFDYLSLGGVFSEGPVSLLSGLNPRPLSLVCHFFAVAIYGVGRLLLPFPSPKRLWIGARLISGASGIIFPIIRAEGVRQMFFPATIPAYYRAPRPN

SEQ ID NO: 28 - protein, 527 aa, Juglans regia
MVDPYALGWSFASVLMGLVALYILVDKKNRSRVSSEARSEGVESVTTTTSGECRLTDGDADVIIVGAGVAGSALAHTLGKDGRRVHVIERDLTEPDRIVGELLQPGGYLKLIELGLEDCVEDIDAQRVFGYALFKDGKNTRLSYPLEKFHSDVSGRSFHNGRFIQRMREKAASLLNVRLEQGTVTSLLEENGTVKGVQYKTKDGNELTAHAPLTIVCDGCFSNLRRSLCNPQVDVPSSFVGLVLENCELPYANHGHVILADPSPILFYPISSTEVRCLVDVPGKKVPSIANGEMEKYLKNMVAPQLPPEIYDSFVAAVDRGNIRTMPNRSMPAAPHPTPGALLMGDAFNMRHPLTGGGMTVALSDIVVLRDLLKPLRDLNDAPTLCKYLESFYTLRKPVASTINTLAGALYKVFCASPDRARKEMRQACFDYLSLGGVFSMGPVSLLSGLNPRPLSLVLHFFAVAVYGVGRLLVPFPSPSRIWIGARLISGASAIIFPIIKAEGVRQMFFPATVPAYYRAPPVKRDH

SEQ ID NO: 29 - protein, 524 aa, Cucumis melo
MVDQCALGWILASVLGASALYLLFGKKNCGVLNERRRESLKNIATTNGECKSSNSDGDIIIVGAGVAGSALAYTLAKDGRQVHVIERDLSEPDRIVGELLQPGGYLKLTELGLEDCVDDIDAQRVYGYALFKDGKDTRLSYPLEKFHSDVSGRSFHNGRFIQRMREKAASLPNVRLEQGTVTSLLEENGTIKGVQYKNKSGQEMTAYAPLTIVCDGCFSNLRRSLCNPKVDVPSCFVGLILENCDLPYANHGHVILADPSPILFYPISSTEIRCLVDVPGQKVPSISNGEMANYLKNVVAPQIPPQLYNSFIAAIDKGNIRTMPNRSMPADPYPTPGALLMGDAFNMRHPLTGGGMTVALSDIVVLRDLLKPLRDLNDAPTLCKYLEAFYTLRKPVASTINTLAGALYKVFCASPDQARKEMRQACFDYLSLGGIFSNGPVSLLSGLNPRPLSLVLHFFAVAIYGVGRLLIPFPSPKRVWIGARLISGASAIIFPIIKAEGVRQMFFPKTVAAYYRAPPVVRER

SEQ ID NO: 30 - protein, 524 aa, Cucumis sativus
MVDQCALGWILASVLGASALYLLFGKKNCGVSNERRRESLKNIATTNGECKSSNSDGDIIIVGAGVAGSALAYTLAKDGRQVHVIERDLSEPDRIVGELLQPGGYLKLTELGLEDCVDEIDAQRVYGYALFKDGKDTRLSYPLEKFHSDVSGRSFHNGRFIQRMREKAASLPNVRLEQGTVTSLLEENGTIRGVQYKNKSGQEMTAYAPLTIVCDGCFSNLRRSLCNPKVDVPSCFVGLILENCDLPHANHGHVILADPSPILFYPISSTEIRCLVDVPGQKVPSISNGEMANYLKNVVAPQIPPQLYNSFIAAIDKGNIRTMPNRSMPADPYPTPGALLMGDAFNMRHPLTGGGMTVALSDIVVLRDLLKPLRDLNDAPTLCKYLEAFYTLRKPVASTINTLAGALYKVFCASPDQARKEMRQACFDYLSLGGIFSNGPVSLLSGLNPRPLSLVLHFFAVAIYGVGRLLIPFPSPKRVWIGARLISGASAIIFPIIKAEGVRQMFFPKTVAAYYRAPPIVRER

SEQ ID NO: 31 - protein, 537 aa, Juglans regia
MVDQYALGLILASVLGFVVLYNLMAKKNRIRVSSEARTEGVQTVITTTNGECRSIEGDVDVIIVGAGVAGSALAHTLGKDGRKVHVIERDLSEPDRIVGELLQPGGYLKLVELGLQDSVEDIDAQRVFGYALFKDGKNTRLSYPLEKFHSDVSGRSFHNGRFIQRMREKAASLPNIRLEQGTVTSLLEENGTIKGVQYKTKDGKELAAHAPLTIVCDGCFSNLRRSLCNPQVDVPSSFVGLVLENCELPYANHGHVVLADPSPILFYPISSTEVRCLVDVPGQKVPSISNGEMAKYLKTMVAPQVPPEIYDSFVAAVDRGNIRTMPNRSMPAAPQPTPGALLMGDAFNMRHPLTGGGMTVALSDIVVLRDLLRPLRDLNDAPTLCKYLESFYTLRKPVASTINTLAGALYKVFCASPDRARNEMRQACFDYLSLGGVFSTGPVSLLSGLNPRPLSLVLHFFAVAVYGVGRLLVPFPSPSRMWIGARLISGASAIIFPIIKAEGVRQMFFPATVPAYYRAPPVNCQARSLKPDALKGL

SEQ ID NO: 32 - protein, 523 aa, Theobroma cacao
MADSYVWGWILGSVMTLVALCGVVLKRRKGSGISATRTESVKCVSSINGKCRSADGSDADVIIVGAGVAGSALAHTLGKDGRRVHVIERDLTEPDRIVGELLQPGGYLKLIELGLEDCVEEIDAQQVFGYALFKDGKHTRLSYPLEKFHSDVSGRSFHNGRFIQRMREKSASLPNVRLEQGTVTSLLEEKGTIRGVQYKTKDGRELTAFAPLTIVCDGCFSNLRRSLCNPKVDVPSCFVGLVLENCNLPYSNHGHVILADPSPILFYPISSTEVRCLVDVPGQKVPSIANGEMANYLKTIVAPQVPPEIYNSFVAAVDKGNIRTMPNRSMPAAPYPTPGALLMGDAFNMRHPLTGGGMTVALSDIVVLRDLLRPLRDLNDAPTLCKYLESFYTLRKPIASTINTLAGALYKVFCASPDQARKEMRQACFDYLSLGGVFSTGPISLLSGLNPRPVSLVLHFFAVAIYGVGRLLLPFPSPKRIWIGARLISGASGIIFPIIKAEGVRQMFFPATVPAYYRAPPVE

SEQ ID NO: 33 - protein, 531 aa, Cucurbita moschata; identical to SEQ ID NO: 22

SEQ ID NO: 34 - protein, 525 aa, Phaseolus vulgaris
MLDTYVFGWIICAALSVFVIRNFVFAGKKCCASSETDASMCAENITTAAGECRSSMRDGEFDVLIVGAGVAGSALAYTLGKDGRQVLVIERDLSEPDRIVGELLQPGGYLKLIELGLEDCVDKIDAQQVFGYALFKDGKHIRLSYPLEKFHSDVAGRSFHNGRFIQRMREKAASLPNVRLEQGTVTSLLEEKGVIKGVQYKTKDSQELSVCAPFTIVCDGCFSNLRRSLCDPKVDVPSCFVGLVLENCELPCANHGHVILGEPSPVLFYPISSTEIRCLVDVPGQKVPSISNGEMAKYLKTVIAPQVPHELHNAFIAAVDKGSIRTMPNRSMPAAPYPTPGALLMGDAFNMRHPLTGGGMTVALSDIVVLRNLLRPLRDLNDAPSLCKYLESFYTLRKPVASTINTLAGALYKVFCASSDPARKEMRQACFDYLSLGGQFSEGPISLLSGLNPRPLTLVLHFFAVATYGVGRLLLPFPSPKRMWIGLRLISSASGIIMPIIKAEGVRQMFFPATVPAYYRNPPAA

SEQ ID NO: 35 - protein, 533 aa, Hevea brasiliensis
MKMADHYLLGWILASVMGLFAFYYIVYLLVKPEEDNNRRSLPQPRSDFVKTMTATNGECRSDDDSDVDVIIVGAGVAGAALAHTLGKDGRRVHVIERDLTEPDRIVGELLQPGGYLKLIELGLEDCVEEIDAQRVFGYALFKDGKHTQLAYPLEKFHSEVAGRSFHNGRFIQRMREKAASLPSVKLEQGTVTSLLEEKGTIKGVLYKTKTGEELTAFAPLTIVCDGCFSNLRRSLCNPKVDVPSCFVGLVLENCRLPYANNGHVILADPSPILFYPISSTEVRSLVDVPGQKVPSVSSGEMANYLKNVVAPQVPPEIYDSFVAAVDKGNIRTMPNRSMPASPYPTPGALLMGDAFNMRHPLTGGGMTVALSDIVVLRDLLKPLRDLHDAPTLCRYLESFYTLRKPVASTINTLAGALYKVFCASPDEARKEMRQACFDYLSLGGVFSTGPVSLLSGLNPRPLSLVLHFFAVAIYGVGRLLLPFPSPHRIWVGARLISGASGIIFPIIKAEGVRQMFFPATVPAYYRAPPIKCN

SEQ ID NO: 36 - protein, 529 aa, Sorghum bicolor
MAAAAAAASGVGFQLIGAAAATLLAAVLVAAVLGRRRRRARPQAPLVEAKPAPEGGCAVGDGRTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLHNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPMGE

SEQ ID NO: 37 - protein, 484 aa, Zea mays
MRKNLEEAGCAVSDGGTDVIIVGAGVAGSALAYTLGKDGRRVHVIERDLTEPDRIVGELLQPGGYLKLIELGLQDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGLVLENCQLPHPNHGHVILANPSPILFYPISSTEVRCLVDVPGQKVPSIATGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPTGEKA

SEQ ID NO: 38 - protein, 524 aa, Medicago sativa
MDLYNIGWILSSVLSLFALYNLIFSGKRNYHDVNDKVKDSVTSTDAGDIQSEKLNGDADVIIVGAGIAGAALAHTLGKDGRRVHIIERDLSEPDRIVGELLQPGGYLKLVELGLQDCVDNIDAQRVFGYALFKDGKHTRLSYPLEKFHSDVSGRSFHNGRFIQRMREKAASLPNVNMEQGTVISLLEEKGTIKGVQYKNKDGQALTAYAPLTIVCDGCFSNLRRSLCNPKVDNPSCFVGLILENCELPCANHGHVILGDPSPILFYPISSTEIRCLVDVPGTKVPSISNGDMTKYLKTTVAPQVPPELYDAFIAAVDKGNIRTMPNRSMPADPRPTPGAVLMGDAFNMRHPLTGGGMTVALSDIVVLRNLLKPMRDLNDAPTLCKYLESFYTLRKPVASTINTLAGALYKVFSASPDEARKEMRQACFDYLSLGGLFSEGPISLLSGLNPRPLSLVLHFFAVAVFGVGRLLLPFPSPKRVWIGARLLSGASGIILPIIKAEGIRQMFFPATVPAYYRAPPVNAF

SEQ ID NO: 39 - protein, 437 aa, Methylomonas lenta
MKEEFDICIIGAGMAGATISAYLAPKGIKIALIDHCYKEKKRIVGELLQPGAVLSLEQMGLSHLLDGFEAQTVKGYALLQGNEKTTIPYPSQHEGIGLHNGRFLQQIRASALENSSVTQIHGKALQLLENERNEIIGVSYRESITSQIKSIYAPLTITSDGFFSNFRAHLSNNQKTVTSYFIGLILKDCEMPFPKHGHVFLSGPTPFICYPISDNEVRLLIDFPGEQLPRKNLLQEHLDTNVTPYIPECMRSSYAQAIQEGGFKVMPNHYMAAKPIVRKGAVMLGDALNMRHPLTGGGLTAVFSDIQILSAHLLAMPDFKNTDLIHEKIEAYYRDRKRANANLNILANALYAVMSNDLLKTAVFKYLQCGGANAQESIAVLAGLNRKHFSLIKQFCFLAVFGACNLLQQSISNIPKALKLLKDAFVIIKPLIKNELS

SEQ ID NO: 40 - protein, 759 aa, Siraitia grosvenorii
MWRLKVGAESVGENDEKWLKSISNHLGRQVWEFCPDAGTQQQLLQVHKARKAFHDDRFHRKQSSDLFITIQYGKEVENGGKTAGVKLKEGEEVRKEAVESSLERALSFYSSIQTSDGNWASDLGGPMFLLPGLVIALYVTGVLNSVLSKHHRQEMCRYVYNHQNEDGGWGLHIEGPSTMFGSALNYVALRLLGEDANAGAMPKARAWILDHGGATGITSWGKLWLSVLGVYEWSGNNPLPPEFWLFPYFLPFHPGRMWCHCRMVYLPMSYLYGKRFVGPITPIVLSLRKELYAVPYHEIDWNKSRNTCAKEDLYYPHPKMQDILWGSLHHVYEPLFTRWPAKRLREKALQTAMQHIHYEDENTRYICLGPVNKVLNLLCCWVEDPYSDAFKLHLQRVHDYLWVAEDGMKMQGYNGSQLWDTAFSIQAIVSTKLVDNYGPTLRKAHDFVKSSQIQQDCPGDPNVWYRHIHKGAWPFSTRDHGWLISDCTAEGLKAALMLSKLPSETVGESLERNRLCDAVNVLLSLQNDNGGFASYELTRSYPWLELINPAETFGDIVIDYPYVECTSATMEALTLFKKLHPGHRTKEIDTAIVRAANFLENMQRTDGSWYGCWGVCFTYAGWFGIKGLVAAGRTYNNCLAIRKACDFLLSKELPGGGWGESYLSCQNKVYTNLEGNRPHLVNTAWVLMALIEAGQAERDPTPLHRAARLLINSQLENGDFPQQEIMGVFNKNCMITYAAYRNIFPIWALGEYCHRVLTE

SEQ ID NO: 41 - protein, 762 aa, Momordica charantia
MWRLKVGAESVGENDEKWVKSISNHLGRQVWEFCPDAGTPQQLLQIEKARKAFQDNRFHRKQTSDLLVSIQCEKGTTNGARVPGTKLKEGEEVRKEAVKSTLERALSFYSSIQTSDGNWASDLGGPMFLLPGLVIALCVTGALNSVLSKHHRQEMCRYLYNHQNEDGGWGLHIESPSTMFGSALNYVALRLLGEDADGGEGRAMTKARAWILGHGGATAITSWGKLWLSVLGVYEWSGNNPLPPEFWLLPYFLPFHPGRMWCHCRMVYLPMSYLYGKRFVGPITPVVLSLRKELYTVPYHEIDWNKSRNTCAKEDLYYPHSKMQDILWGSIHHMYEPLFTHWPAKRLREKALKTAMQHIHYEDENTRYICLGPVNKVLNMLCCWVEDPYSEAFKLHLQRVHDYLWVAEDGMKMQGYNGSQLWDTAFSVQAIISTKLVDNYGPTLRKAHDYVKNSQIQQDCPGEPNVWFRHIHKGAWPFSTRDHGWLISDCTAEGLKASLMLSKLPSETVGEPLERNRLCDAVNVLLSLQNDNGGFASYELTRSYPWLELINPAETFGDIVIDYPYVECTSATMEALALFKKLHPGHRTKEIDTAIARAADFLENMQRTDGSWYGCWGVCFTYAGWFGIKGLVAAGRAYSNCLAIRKACDFLLSKELPGGGWGESYLSCQNKVYTNLEGNRPHLVNTAWVLMALIEAGQGERDPAPLHRAARLLINSQLENGDFPQEEIMGVFNKNCMITYAAYRNIFPIWALGEYCHRVLTE

SEQ ID NO: 42 - protein, 764 aa, Cucurbita maxima
MWRLKVGAESVGEKDEKWVKSVSNHLGRQVWEFCADAAADTPHQLLQIQNARNHFHHNRFHRKQSSDLFLAIQYEKEIAKGAKGGAVKVKEGEEVGKEAVKSTLERALGFYSAVQTSDGNWASDLGGPMFLLPGLVIALHVTGVLNSVLSKHHRVEMCRYLYNHQNEDGGWGLHIEGTSTMFGSALNYVALRLLGEDADGGDGGAMTKARAWILERGGATAITSWGKLWLSVLGVYEWSGNNPLPPEFWLLPYSLPFHPGRMWCHCRMVYLPMSYLYGKRFVGPITPKVLSLRQELYTIPYHEIDWNKSRNTCAKEDLYYPHPKMQDILWGSIYHVYEPLFTRWPGKRLREKALQAAMKHIHYEDENSRYICLGPVNKVLNMLCCWVEDPYSDAFKLHLQRVHDYLWVAEDGMRMQGYNGSQLWDTAFSIQAIVATKLVDSYAPTLRKAHDFVKDSQIQEDCPGDPNVWFRHIHKGAWPFSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAIGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 43 - protein, 764 aa, Citrullus colocynthis
MWRLKVGAESVGEKEEKWLKSISNHLGRQVWEFCADQPTASPNHLQQIDNARKHFRNNRFHRKQSSDLFLAIQNEKEIANGTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARGWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNKSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWIAEDGMRMQGYNGSQLWDTAFSVQAIISTKLIDSFGTTLKKAHDFVKDSQIQQDFPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDTAVAKAANFLENMQRTDGSWYGCWGVCFTYAGWFGIKGLVAAGRTYSTCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 44 - protein, 764 aa, Citrullus colocynthis
MWRLKVGAESVGEKEEKWLKSISNHLGRQVWEFCAHQPTASPNHLQQIDNARNHFRNNRFHRKQSSDLFLAIQNEKEIANVTKGGGIKVKEEEDVRKETVKNTVERALSFYSAIQTNDGNWASDLGGPMFLLPGLVIALYVTGVLNSVLSKHHRQEMCRYLYNHQNEDGGWGLHIEGTSTMFGSALNYVALRLLGEDADGGEGGAMTKARSWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNRSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWVAEDGMRMQGYNGSQLWDTAFSVQAIISTKLIDSFGTTLKKAHDFVKDSQIQQDCPGDPNVWFRHIHKGAWPFSTRDHGWLISDCTAEGLKASLMLSKLPSKIVGEPLEKSRLCDAVNVLLSLQNENGGFASYELTRSYPWLELINPAETFGDIVIDYPYVECTSATMEALTLFKKLHPGHRTKEIDIAVARAANFLENMQRTDGSWYGCWGVCFTYAGWFGIKGLVAAGRTYNSCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 45 - protein, 765 aa, Cucurbita moschata
MWRLKVGAESVGEKDEKWVKSVSNHLGRQVWEFCADAAAAATPRQLLQIQNARNHFHRNRFHRKQSSDLFLAIQYEKEIAEGGKGGAVKVKEEEEVGKEAVKSTLERALSFYSAVQTSDGNWASDLGGPMFLLPGLVIALYVTGVLNSVLSKHHRVEMCRYLYNHQNEDGGWGLHIEGTSTMFGSALNYVALRLLGEDADGGDDGAMTKARAWILERGGATAITSWGKLWLSVLGVYEWSGNNPLPPEFWLLPYSLPFHPGRMWCHCRMVYLPMSYLYGKRFVGPITPKVLSLRQELYTVPYHEIDWNKSRNTCAKEDLYYPHPKMQDILWGSIYHVYEPLFTRWPGKRLREKALQTAMKHIHYEDENSRYICLGPVNKVLNMLCCWVEDPYSDAFKLHLQRVHDYLWVAEDGMRMQGYNGSQLWDTAFSIQAIVATKLVDSFAPTLRKAHDFVKDSQIQEDCPGDPNVWFRHIHKGAWPFSTRDHGWLISDCTAEGLKASLMLSKLPSTMVGEPLEKNRLCDAVNVLLSLQNDNGGFASYELTRSYPWLELINPAETFGDIVIDYPYVECTAATMEALTLFKKLHPGHRTKEIDTAVGKAANFLEKMQRADGSWYGCWGVCFTYAGWFGIKGLVAAGRTYNSCLAIRKACEFLLSKELPGGGWGESYLSCQNKVYTNLEGNKPHLVNTAWVLMALIEAGQGERDPAPLHRAARLLMNSQLENGDFVQQEIMGVFNKNCMITYAAYRNIFPIWALGEYCHRVLTE

SEQ ID NO: 46 - protein, 785 aa, Cucumis sativus
MWRLKVGKESVGEKEEKWIKSISNHLGRQVWEFCAENDDDDDDEAVIHVVANSSKHLLQQQRRQSSFENARKQFRNNRFHRKQSSDLFLTIQYEKEIARNGAKNGGNTKVKEGEDVKKEAVNNTLERALSFYSAIQTSDGNWASDLGGPMFLLPGLVIALYVTGVLNSVLSKHHRQEMCRYIYNHQNEDGGWGLHIEGSSTMFGSALNYVALRLLGEDANGGECGAMTKARSWILERGGATAITSWGKLWLSVLGVYEWSGNNPLPPEFWLLPYSLPFHPGRMWCHCRMVYLPMSYLYGKRFVGPITHMVLSLRKELYTIPYHEIDWNRSRNTCAQEDLYYPHPKMQDILWGSIYHVYEPLFNGWPGRRLREKAMKIAMEHIHYEDENSRYIYLGPVNKVLNMLCCWVEDPYSDAFKFHLQRIPDYLWLAEDGMRMQGYNGSQLWDTAFSIQAILSTKLIDTFGSTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAALAKAANFLENMQRTDGSWYGCWGVCFTYAGWFGIKGLVAAGRTYNNCVAIRKACHFLLSKELPGGGWGESYLSCQNKVYTNLEGNRPHLVNTAWVLMALIEAGQGERDPAPLHRAARLLINSQLENGDFPQQEIMGVFNKNCMITYAAYRNIFPIWALGEYSHRVLTE

SEQ ID NO: 47 - protein, 774 aa, Cucumis melo
MWRLKVGKESVGEKEEKWIKSISNHLGRQVWEFCSGENENDDDEAIAVANNSASKFENARNHFRNNRFHRKQSSDLFLAIQCEKEIIRNGAKNEGTTKVKEGEDVKKEAVKNTLERALSFYSAVQTSDGNWASDLGGPMFLLPGLVIALYVTGVLNSVLSKHHRQEMCRYIYNHQNEDGGWGLHIEGSSTMFGSALNYVALRLLGEAADGGEHGAMTKARSWILERGGATAITSWGKLWLSVLGVYEWSGNNPLPPEFWLLPYSLPFHPGRMWCHCRMVYLPMSYLYGKRFVGPITPIVLSLRKELYTIPYHEIDWNRSRNTCAKEDLYYPHPKMQDILWGSIYHVYEPLFSGWPGKRLREKAMKIAMEHIHYEDENSRYICLGPVNKVLNMLCCWVEDPYSDAFKFHLQRIPDYLWLAEDGMRMQGYNGSQLWDTAFSIQAIISTKLIDTFGPTLRKAHHFVKHSQIQEDCPGDPNVWFRHIHKGAWPFSTRDHGWLISDCTAEGLKASLMLSKLPSKIVGEPLEKNRLCDAVNVLLSLQNENGGFASYELTRSYPWLELINPAETFGDIVIDYSYVECTSATMEALALFKKLHPGHRTKEIDAAIAKAANFLENMQKTDGSWYGCWGVCFTYAGWFGIKGLVAAGRTYNNCVAIRKACNFLLSKELPGGGWGESYLSCQNKVYTNLEGNKPHLVNTAWVMMALIEAGQGERDPAPLHRAARLLINSQLESGDFPQQEIMGVFNKNCMITYAAYRNIFPIWALGEYSHRVLDM

SEQ ID NO: 48 - protein, 647 aa, Citrullus lanatus subsp. vulgaris
DGNWASDLGGPMFLLPGLVIALYVTGVLNSVLSKHHRQEMCRYLYNHQNEDGGWGLHIEGTSTMFGSALNYVALRLLGEDADGGEGGAMTKARSWILDRGGATAITSWGKLWLSVLGVYEWSGNNPLPPEFWLLPYCLPFHPGRMWCHCRMVYLPMSYLYGKRFVGPITPIVLSLRKELYTIPYHEIDWNRSRNTCAKEDLYYPHPKMQDILWGSIYHLYEPLFTRWPGKRLREKALQMAMKHIHYEDENSRYICLGPVNKVLNMLCCWVEDPYSDAFKFHLQRVPDYLWVAEDGMRMQGYNGSQLWDTAFSVQAIISTKLIDSFGTTLKKAHDFVKDSQIQQDCPGDPNVWFRHIHKGAWPFSTRDHGWLISDCTAEGLKASLMLSKLPSEIVGEPLEKSRLCDAVNVLLSLQNENGGFASYELTRSYPWLELINPAETFGDIVIDYPYVECTSATMEALTLFKKLHPGRRTKEIDIAVARAANFLENMQRTDGSWYGCWGVCFTYAGWFGIKGLVAAGRTYNSCVAIRKACDFLLSKELPGGGWGESYLSCQNKVYTNLEGNRPHLVNTAWVLMALIEAGQAERDPAPLHRAARLLINSQLENGDFPQEEIMGVFNKNCMITYAAYRNIFPIWALGEYFHRVLTE

SEQ ID NO: 49 - protein, 761 aa, Theobroma cacao
MWRLKIGKESVGDNGAWLRSSNDHVGRQVWEFCPESGTPEELSKVEMARQSFSTDRLLKKHSSDLLMRIQYAKENQFVTNFPQVKLKEFEDVKEEATLTTLRRALNFYSTIQADDGHWPGDYGGPMFLLPGLVITLSVTGALNAVLSKEHQYEMCRYLYNHQNRDGGWGLHIEGPSTMFGTVLNYVTLRLLGEGPEGGQGAVEKACEWILEHGSATAITSWGKMWLSVLGAYEWSGNNPLPPEVWLCPYFLPIHPGRMWCHCRMVYLPMSYLYGKRFVGPITPIILSLRKELYAVPYHEVDWNKARNTCAKEDLYYPHPLVQDILWASLHYLYEPIFTRWPCKSLREKALRTVMQHIHYEDENTRYICIGPVNKVLNMLSCWVEDPYSESFKLHLPRILDYLWIAEDGMKMQGYNGSQLWDTAFAVQAIISTGLADEYGPILRKAHDFIKYSQVLEDCPGDLNFWYRHISKGAWPFSTVDHGWPISDCTSEGLKAVLLLSTLPSESVGEPLHMMRLYDAVNVILSLQNVDGGFPTYELTRSYQWLELINPAETFGDIVIDYPYVECTSAAIQALISFKKLFPEHRMEEIENCIGRAVEFIEKIQAADGSWYGSWGVCFTYAGWFGIKGLSAAGRTYNNSSNIRKACDFLLSKELATGGWGESYLSCQNKVYTNLEGARPHIVNTSWALLALIEAGQAERDPTPLHRAARILINSQMEDGDFPQEEIMGVFNKNCMISYSAYRNIFPIWALGEYTCRVLRAP

SEQ ID NO: 50 - protein, 763 aa, Ziziphus jujube
MWKLKIGAETVGEGGSDGWLRSVNSHLGRQVWEFHPELGTPEELRQIQDARDAFFNHRFHKQHSSDLLMRIQFAKENPCVANPPQVKVKDTDEVTEESVTTTLRRAINFYSTIQAHDGHWAGDYGGPMFLLPGLVITLSVTGALNAVLSKEHQCEMCRYIYNHQNEDGGWGLHIEGPSTMFGTVLNYVSLRLLGEGAEDGLGTIENARKWILDHGGATAITSWGKMWLSVLGVYEWSGNNPLPPEVWLCPYTLPFHPGRMWCHCRMVYLPMSYLYGKRFVGPITPTIRSLRKELYTAPYHEIDWNRARNECAKEDLYYPHPLVQDVLWASLHYVYEPIFMRWPAKKLREKALSTVMQHIHYEDENTRYICIGPVNKVLNMLCCWVEDPNSEAFKLHLPRISDYLWIAEDGMKMQGYNGSQLWDTAFAVQAIVSTDLAEEYGPTIRKAHEYIKNSQVLEDCPGDLNFWYRHISKGAWPFSTADHGWPISDCTAEGLKAVLLLSQLSSETVGDSLDVKRLFNAVNVILSLQNGDGGFATYELTRSYQWLELINPAETFGDIVIDYPYVECTSAALEALTLFKKSYPGHRREEVENCITNAAMFIENIQAKDGSWYGSWGVCFTYAGWFGIKGLVASGRTYENCPSIRKACDFLLSKELPSGGWGESYLSCQNKVYTNLKDNKPHIVNTAWAMLALIVARQAERDPMPLHRAARILIKSQMHDGDFPQEEIMGVFNKNCMISYAAYRNIFPIWALGEYRLHVLRSL

SEQ ID NO: 51 - protein, 762 aa, Prunus avium
MWKLKIGAETVGEGGYQWLKSVNNHLGRQVWEFNPELGSPEELQRIEDARKAFWDNRFERRHSSDLLMRIQFEKENQCVTNLPQLKVKYEEEVTEEVVKTTLRRAISFYSTIQAHDGHWPGDYGGPMFLLPGLVITLSITGALNDVLSKEHQHEMCRYLYNHQNKDGGWGLHIEGPSTMFGTALNYVTLRLFGEGADDGEGAMELARKWILDHGGVTKITSWGKMWLSVLGTYEWSGNNPLPPEVWLCPYSLPFHPGRMWCHCRMVYLPMSYLYGKRFVGPITPTIRSLRKELYGVPYHEVDWNQARNLCAKEDLYYPHPMVQDILWASLHYVYEPVFTRWPAKKLRENALQTVMQHIHYEDENTRYICIGPVNKVLNMLCCWAEDPNSDAFKLHLPRIPDYLWVAEDGMKMQGYNGSQSWDTSFAVQAIISTNLAEEFGPTLRKAHEYIKDSQVLEDCPGDLNFWYRHISKGAWPFSTADHGWPISDCTAEGLKAVLLLSKLPTGTVGESLDMKQLYDAVNVMLSLQNEDGGFATYELTRSYQWLELINPAETFGDIVIDYPYVECTSAAIQALTMFRKLYPGHRREEIESCIARAAKFIEKIQATDGSWYGSWGVCFTYAGWFGIKGLAAAGRTYKDCSSIRKACDFLLSKELPSGGWGESYLSCQNKVYTNLKDNRPHIVHTAWAMLALIGAGQAKRDPTPLHRAARVLINSQMENGDFPQKEIMGVFNKNCMISYSAYRNIFPIWALGEYRCQVLEAL

SEQ ID NO: 52 - protein, 759 aa, Brassica napus
MWKLKIAEGGSPWLRTTNNHVGRQFWEFDPNLGTPEELAAVEEARKSFRENRFAKKHSSDLLMRLQFSRESLSRPVLPQVNIKDGDDVTEKMVETTLKRGVDFYSTIQASDGHWAGDYGGPMFLLPGLIITLSITGALNTVLSEQHKAEMRRYLHNHQNEDGGWGLHIEGPSTMFGSVLNYVTLRLLGEGPNDGDGAMEKGRDWILNHGGATNITSWGKMWLSVLGAFEWSGNNPLPPEIWLLPYILPIHPGRMWCHCRMVYLPMSYLYGKRFVGPITSTVLSLRKELFTVPYHEVDWNEARNLCAKEDLYYPHPLVQDILWASLHKIVEPVLTRWPGSNLREKALRTTLEHIHYEDENTRYICIGPVNKVLNMLCCWVEDPNSEAFKLHLPRIHDYLWVAEDGMKMQGYNGSQLWDTSFAVQAVLATNFVEEYGPVLKKAHSYVKNSQVSEDCPGDLSYWYRHISKGAWPFSTADHGWPISDCTAEGLKAALLLSKVPKEIVGEPVDTKRLYDAVNVIISLQNADGGFATYELTRSYPWLELINPAETFGDIVIDYPYVECTSAAIQALIAFRKLYPGHRKKEVDECIEKAVKFIESIQESDGSWYGSWAVCFTYGTWFGVKGLEAAGKTLKNSPTVAKACEFLLSKQLPSGGWGESYLSCQDKVYSNLDGNRSHVVNTAWALLSLIGAGQVEVDQKPLHRAARYLINAQMESGDFPQQEIMGVFNRNCMITYAAYRNIFPIWALGEYRSKVLLQQGE

SEQ ID NO: 53 - protein, 756 aa, Spinacia oleracea
MWKLKIAEGGSPWLRTTNNHVGRQIWEFDPNLGTPEQIREVEEARENFWKNRFEQKHSSDLLMRMQFAQENSSNVVLPQVKVKDEDEITEETVATTLRRALSYQSTIQAHDGHWPGDYGGPMFLMPGLVIALSVTGALNAVLSKEHQKEMCRYLYNHQNKDGGWGLHIEGHSTMFGTVLTYVTLRLLGEGVDDGDGAMERGRKWTLEHGSATAITSWGKMWLSVLGVFEWAGNNPMPPETWLLPYILPVHPGRMWCHCRMVYLPMSYLYGKRFVGPITPTVLSLRRELFDVPYHEIDWDRARNECAKEDLYYPHPLVQDILWASLHKAVEPILMRWPGKKLREKALSTVMEHIHYEDENTRYICIGPVNKVLNMLCCWVEDPNSEAFKLHLPRIPDFLWIAEDGMKMQGYNGSQLWDTTFMVQAILATNLGEEYGGTLRKAHNFIKDSQVREDCPGDLSYWYRHISKGAWPFSTADHGWPISDCTAEGLKAALLLSKVPSDIVGEPLEVKRLYDSVNVLLSLQNGDGGFATYELTRSYPWLELINPAETFGDIVIDYPYVECTSAAIQALVSFKRLYPGHRREEIENCIKKAAKFIEDIQAADGSWYGSWAVCFTYATWFGIKGLVAAGKNYDNCPAIRKACDFLLSKQLSNGGWGESYLSCQNKVYSNIEGNKAHVVNTGWAMLALIGAGQAKRDPMPLHRAAKVLINSQMPNGDFPQQEIMGVFNRNCMITYAAYRNIFPTWALGEYRTQVLQK

SEQ ID NO: 54 - protein, 756 aa, Trigonella foenum-graecum
  misc_feature (425)..(425): Xaa can be any naturally occurring amino acid
MWKLKVAEGGSPWLRTVNNYVGRQVWEFDPNSGSPQELDQIESVRQNFHNNRFSHKHSDDLLMRIQLAKENPMGEVIPKVRVKDVEDVNEESVTTTLRRALNFYSTLQSRDGHWPGDYGGPMFLMPGLVIALSITGALNAVLTDEHQKEMRRYLYNHQNKDGGWGLHIEGPSTMFGSVLCYVTLRLLGEGPNDGEGEMEKARDWILEHGGATYITSWGKMWLSVLGVFEWSGNNPLPPEIWLLPYMLPIHPGRMWCHCRMVYLPMSYLYGKRFVGPITPTVLSLRKELFTVPYHDIDWNQARNLCAKEDLYYPHPLVQDILWASLHKFVEPIFMNWPGKKLREKAVETVMEHVHYEDENTRYICIGPVNKVLNMLCCWVEDPNSEAFKLHLPRIHDFLWIAEDGMKMQGYNGSQLWDTAFAVQAXISTNLIDEFAPTLRKAHTFIKNSQVLEDCPGDLSKWYRHISKGAWPFSTADHGWPISDCTAEGLKAVLLLSKIGPEIVGEPLDAKGFYDAVNVIISLQNEDGGLATYELTRSYKWLEIINPAETFGDIVIDYTYVECTSAAIQALSTFRKLYPGHRREEIQHCIEKAAAFIEKIQASDGSWYGSWGVCFTYGTWFGVKGLIAAGKSFSNCLSIRKACDFLLSKQLPSGGWGESYLSCQNKVYSNLESNRSHVVNTGWAMLALIEAEQAKRDPTPLHHAAVCLINSQMENGDFPQEEIMGVFNKNCMITYAAYRNIFPIWALGEYRRHVLQA

SEQ ID NO: 55 - protein, 759 aa, Ricinus communis
MWKLRIAEGSGNPWLRTTNDHIGRQVWEFDSSKIGSPEELSQIENARQNFTKNRFIHKHSSDLLMRIQFSKENPICEVLPQVKVKESEQVTEEKVKITLRRALNYYSSIQADDGHWPGDYGGPMFLMPGLIIALSITGALNAILSEEHKREMCRYLYNHQNRDGGWGLHIEGPSTMFGSVLCYVSLRLLGEGPNEGEGAVERGRNWILKHGGATAITSWGKMWLSVLGAYEWSGNNPLPPEMWLLPYILPVHPGRMWCHCRMVYLPMSYLYGKRFVGPITPTVLSLRKELYTVPYHEIDWNQARNQCAKEDLYYPHPMLQDVLWATLHKFVEPILMHWPGKRLREKAIQTAIEHIHYEDENTRYICIGPVNKVLNMLCCWVEDPNSEAFKLHLPRLYDYLWLAEDGMKMQGYNGSQLWDTAFAVQAIVSTNLIEEYGPTLKKAHSFIKKMQVLENCPGDLNFWYRHISKGAWPFSTADHGWPISDCTAEGIKALMLLSKIPSEIVGEGLNANRLYDAVNVVLSLQNGDGGFPTYELSRSYSWLEFINPAETFGDIVIDYPYVECTSAAIQALTSFRKSYPEHQREEIECCIKKAAKFMEKIQISDGSWYGSWGVCFTYGTWFGIKGLVAAGKSFGNCSSIRKACDFLLSKQCPSGGWGESYLSCQKKVYSNLEGDRSHVVNTAWAMLSLIDAGQAERDPTPLHRAARYLINAQMENGDFPQQEIMGVFNRNCMITYAAYRDIFPIWALGEYRCRVLKAS

SEQ ID NO: 56 - protein, 313 aa, Siraitia grosvenorii
MEKIEHSTIATNGINMHVASAGSGPAVLFLHGFPELWYSWRHQLLYLSSLGYRAIAPDLRGFGDTDAPPSPSSYTAHHIVGDLVGLLDQLGVDQVFLVGDWGAMMAWYFCLFRPDRVKALVNLSVHFTPRNPAISPLDGFRLMLGDDFYVCKFQEPGVAEADFGSVDTATMFKKFLTMRDPRPPIIPNGFRSLATPEALPSWLTEEDIDYFAAKFAKTGFTGGFNYYRAIDLTWELTAPWSGSEIKVPTKFIVGDLDLVYHFPGVKEYIHGGGFKKDVPFLEEVVVMEGAAHFINQEKADEINSLIYDFIKQF

SEQ ID NO: 57 - protein, 316 aa, Siraitia grosvenorii
MEKIEHTTISTNGINMHVASIGSGPAVLFLHGFPELWYSWRHQLLFLSSMGYRAIAPDLRGFGDTDAPPSPSSYTAHHIVGDLVGLLDQLGIDQVFLVGHDWGAMMAWYFCLFRPDRVKALVNLSVHFLRRHPSIKFVDGFRALLGDDFYFCQFQEPGVAEADFGSVDVATMLKKFLTMRDPRPPMIPKEKGFRALETPDPLPAWLTEEDIDYFAGKFRKTGFTGGFNYYRAFNLTWELTAPWSGSEIKVAAKFIVGDLDLVYHFPGAKEYIHGGGFKKDVPLLEEVVVVDGAAHFINQERPAEISSLIYDFIKKF

SEQ ID NO: 58 - protein, 316 aa, Siraitia grosvenorii
MDQIEHITINTNGIKMHIASVGTGPVVLLLHGFPELWYSWRHQLLYLSSVGYRAIAPDLRGYGDTDSPASPTSYTALHIVGDLVGALDELGIEKVFLVGHDWGAIIAWYFCLFRPDRIKALVNLSVQFIPRNPAIPFIEGFRTAFGDDFYMCRFQVPGEAEEDFASIDTAQLFKTSLCNRSSAPPCLPKEIGFRAIPPPENLPSWLTEEDINYYAAKFKQTGFTGALNYYRAFDLTWELTAPWTGAQIQVPVKFIVGDSDLTYHFPGAKEYIHNGGFKKDVPLLEEVVVVKDACHFINQERPQEINAHIHDFINKF

SEQ ID NO: 59 - protein, 314 aa, Momordica charantia
MEKIEHSTIAANGITIHVASVGSGPAVLLLHGFPELWYSWRHQLLFLASKGYRAIAPDLRGFGDSDAPPSPSSYTPLHIVGDLVALLDHLGIDLVFLVGHDWGAMMAWHFCLLRPDRVKALVNLSVHFMPRNPAMSPLDGMRLLLGDDFYVCRFQEPGAAEADFGSVDTATMMKKFLTMRDPRPPIIPNGFRSLETPQALPPWLTEEDIDYFAAKFAKTGFTGGFNYYRAIGRTWELTAPWTGSKIKVPAKFIVGDLDMVYHLPDAKEYIHGGGFKEDVPLLEEVVVIEGAAHFINQEKPDEISSLIYDFIKKF

SEQ ID NO: 60 - protein, 314 aa, Cucurbita moschata
MEKIEHSTIATNGINMHVASIGSGPPVLFLHGFPELWYSWRHQLLFLASKGFRAIAPDLRGFGDSDVPPSPSSYTPFHIIGDLIGLLDHLGIEQVFLVGHDWGAMMAWYFCLFRPDRVKALVNLSVHYNPRNPAISPLSRTRQFLGDDFYICKFQTPGVAEADFGSVDTATMMKKFLTIRDPSPPIIPNGFKTLKTPETLPSWLTEEDIDYFASKFTKTGFTGGFNYYRAIEQTWELTGPWSGAKIKVPTKYVVGDVDMVYHLPGAKQYIHGGGFKKDVPLLEEVVVMEGAAHFINQEKADEISAHIYDFIIKF

SEQ ID NO: 61 - protein, 316 aa, Cucurbita maxima
MENIEHTIVPTNGINMHIASIGSGPAVLFLHGFPELWYSWRHQLLFLASNGFRAIAPDLRGFGDTDVPPSPSSYTAHHIVGDLIGLLDHLGIDRVFLVGHDWGAMMAWYFCLFRPDRVRALVNLSVHYLHRHPSIKFVDGFRAFLGDDFYFCQFQEPGVAEADFGSVDTATMLKKFLTMRDPRPPMIPKEKGFRALETPDPLPSWLTEEDVDYFASKFSKTGFTGGFNYYRAFDLSWELTAPWSGSQVKVPAKFIVGDLDLVYHFPGAKEYIHGGRFKEDVPFLEEVVVIEGAAHFINQERADEISSLIYEFINKF

SEQ ID NO: 62 - protein, 316 aa, Prunus persica
MEKIEHTTVSTNGINMHIASIGTGPVVLFLHGFPELWYSWRHQLLSLSSLGYRCIAPDLRGFGDTDAPPSPASYSALHIVGDLIGLLDHLGIDQVFLVGHDWGAVIAWWFCLFRPDRVKALVNMSVAFSPRNPKRKPVDGFRALFGDDYYICRFQEPGEIEKEFAGYDTTSIMKKFLTGRSPKPPCLPKELGLRAWKTPETLPPWLSEEDLNYFASKFSKTGFVGGLNYYRALNLTWELTGPWTGLQVKVPVKFIVGDLDITYHIPGVKNYIHNGGFKRDVPFLQEVVVIEDGAHFINQERPDEISRHVYDFIQKF

SEQ ID NO: 63 - protein, 316 aa, Morus notabilis
MEKIEHSTVHTNGINMHVASVGTGPAILFLHGFPELWYSWRHQMISLSSLGYRCIAPDLRGYGDTDAPPSPTSYTSLHIVGDLVGLIDHLVIEKLFLVGHDWGAMIAWYFCLFRPDRIKALVNLSVPFFPRNPKINFVDGFRAELGDDFYICRFQEPGESEADFSSDTVAVFRRILANRDPKPPLIPKEIGFRGVYEDPVALPSWLTEDDINHFANKFNETGFTGGLNYYRALNLTWELTAAWTGARVQVPTKFIMGDLDLVYYFPGMKEYILNGGFKRDVPLLQELVIIEGAAHFINQEKPDEISSHIHHFIQKF

SEQ ID NO: 64 - protein, 316 aa, Ricinus communis
MEKIEHTTVATNGINMHVAAIGTGPEILFLHGFPELWYSWRHQLLSLSSRGYRCIAPDLRGYGDTDAPESLTGYTALHIVGDLIGLLDSMGIEQVFLVGHDWGAMMAWYLCMFRPDRIKALVNTSVAYMSRNPQLKSLELFRTVYGDDYYVCRFQEPGGAEEDFAQVDTAKLIRSVFTSRDPNPPIVPKEIGFRSLPDPPSLPSWLSEEDVNYYADKFNKKGFTGGLNYYRNIDQNWELTAPWDGLQIKVPVKFVIGDLDLTYHFPGIKDYIHNGGFKQVVPLLQEVVVMEGVAHFINQEKPEEISEHIYDFIKKF

SEQ ID NO: 65 - protein, 316 aa, Citrus unshiu
MEKIEHTTVGTNGINMHVASIGTGPVVLFIHGFPELWYSWRNQLLYLSSRGYRAIAPDLRGYGDTDAPPSVTSYTALHLVGDLIGLLDKLGIHQVFLVGHDWGALIAWYFCLFRPDRVKALVNMSVPFPPRNPAVRPLNNFRAVYGDDYYICRFQEPGEIEEEFAQIDTARLMKKFLCLRIAKPLCIPKDTGLSTVPDPSALPSWLSEEDVNYYASKFNQKGFTGPVNYYRCSDLNWELMAPWTGVQLEVPVKFIVGDQDLVYNNKGMKEYIHNGGFKKYVPYLQEVVVMEGVAHFINQEKAEEVGAHIYEFIKKF

SEQ ID NO: 66 - protein, 316 aa, Hevea brasiliensis
MEKIEHITVFTNGINMHIASIGTGPEILFLHGFPELWYSWRHQLLSLSSLGYRCIAPDLRGYGDTDAPQSVNQYTVLHIVGDLVGLLDSLGIQQVFLVGHDWGAFIAWYFCIFRPDRIKALVNTSVAFMPRNPQVKPLDGLRSMFGDDYYICQFQKPGKAEEDFAQVNTAKLIKLLFTSRDPRPPHFLKEVGLKALQDPPSQQSWLTEEDVNFYAAKFNQKGFRGGLNYYQNINMNWELAAAWTGVQIKVPVKFIIGDLDLTYHFPGIKEYIHNGGFKKDVPLLQDVVVMEGVAHFLNQEKPEEVSKHIYDFIKKF

SEQ ID NO: 67 - protein, 317 aa, Handroanthus impetiginosus
MDKIQHKIIQTNGINIHVAEIGDGPAVLFLHGFPELWYSWRHQMLFLSSRGYRAIAPDLRGYGDSDAPPCATSYTAFHIIGDLVGLLDAMGLDRVFLVGHDWGAVMAWYFCLLRPDRIKALVNLSVVFQPRNPKRKPVESMRAKLGDDYYICRFQEPGEAEEEFARVDTARLIKKLLTTRNPAPPRLPKEVGFGCLPHKPITMPSWLSEEDVQYYAAKFNQKGFTGGLNYYRAMDLSWELAAPWTGVQIKVPVKFIVGDLDITYNTPGVKEYIHKGRFKQHVPFLQELVILEGVAHFLNQEKPDEINQHIYDFIHKF

SEQ ID NO: 68 - protein, 324 aa, Camelina sativa
MEKIEHTTVSTNGINMHVASIGSGPVILFLHGFPDLWYSWRHQLLSFAALGYRAIAPDLRGYGDSDAPPSPESYTILHIVGDLVGLLDSLGVDRVFLVGHDWGAIVAWWLCMIRPDRVKALVNTSVVFNPRNPSVKPVDKFRDLFGDDYYVCRFQETGEIEEDFAQVDTKKLITRFFVSRNPRPPCIPKSVGFRGLPDPPSLPAWLTEQDVSFYGDKFSQKGFTGGLNYYRAMNLSWELTAPWAGLQIKVPVKFIVGDLDITYNIPGTKEYIHGGGLKKHVPFLQEVVVMEGVGHFLQQEKPDEVTDHIYGFFEKFRTRETSSL

SEQ ID NO: 69 - protein, 317 aa, Coffea canephora
MDKIQHRQVPVNGINLHVAEIGDGPAILFLHGFPELWYSWRHQLLSLSAKGYRALAPDLRGYGDSDAPPSPSNYTALHIVGDLVGLLDSLGLDRVFLVGHDWGAVMAWYFCLLRPDRIKALVNMSVVFTPRNPKRKPLEAMRARFGDDYYICRFQEPGEAEEEFARVDTARIIKKFLTSRRPGPLCVPKEVGFGGSPHNPIQLPSWLSEDDVNYFASKFSQKGFTGGLNYYRAMDLNWELTAPWTGLQIKVPVKFIVGDLDVTFTTPGVKEYIQKGGFKRDVPFLQELVVMEGVAHFVNQEKPEEVSAHIYDFIQKF

SEQ ID NO: 70 - protein, 318 aa, Punica granatum
MEKIQHTTVRTNGINMHVATAGSGPDSILFVHGFPELWYTWRHQMVSLAALGYRTIAPDLRGYGDTDAPPSHESYTAFHIVGDLVGLLDSMGIEKVFLVGHDWGAAIAWYFCLFRPDRIKALVNMSVVFHPRNPNRKPVDGLRAILGDDYYICRFQAPGEIEEDFARADTANIIKFFLVSRNPRPPQIPKEGFSCLANSRQMDLPSWLSEEDINYYASKFSEKGFTGGLNYYRVMNLNWELTAPFTGLQIKVPAKFMVGDLDITYNTPGTKEFIHNGGLKKHVPFLQEVVVMEGVAHFINQEKPEEVTAHIYDFIKKF

SEQ ID NO: 71 - protein, 324 aa, Arabidopsis lyrata subsp. lyrata
MEKIEHTTVSTNGINMHVASIGSGPVILFLHGFPDLWYSWRHQLLSFAALGYRAIAPDLRGYGDSDAPPSRESYTILHIVGDLVGLLNSLGVDRVFLVGHDWGAIVAWWLCMIRPDRVNALVNTSVVFNPRNPSVKPVDAFRALFGDDYYICRFQEPGEIEEDFAQVDTKKLITRFFISRNPRPPCIPKSVGFRGLPDPPSLPAWLTEEDVSFYGDKFSQKGFTGGLNYYRALNLSWELTAPWAGLQIKVPVKFIVGDLDITYNIPGTKEYIHEGGLKKHVPFLQEVVVLEGVGHFLHQEKPDEITDHIYGFFKKFRTRETASL

SEQ ID NO: 72 - protein, 316 aa, Rhinolophus sinicus
MDKIEHTTVSTNGINMHVASIGSGPVILFLHGFPDLWYSWRHQLLSFAGLGYRAIAPDLRGYGDSDSPPSHESYTILHIVGDLVGLLDSLGVDRVFLVGHDWGAVVAWWLCMIRPDRVNALVNTSVVFNPRNPSVKPVDAFKALFGEDYYVCRFQEPGEIEEDFAQVDTKKLINRFFTSRNPRPPCIPKTLGFRGLPDPPALPAWLTEQDVSFYADKFSQKGFTGGLNYYRAMNLSWELTAPWAGLQIKVPVKFIVGDLDITYNIPGTKEYIHEGGLKKHVPFLQEVVVMEGVGHFLHQEKPDEVTDHIYGFFKKF

SEQ ID NO: 73 - protein, 473 aa, Siraitia grosvenorii
MWTVVLGLATLFVAYYIHWINKWRDSKFNGVLPPGTMGLPLIGETIQLSRPSDSLDVHPFIQKKVERYGPIFKTCLAGRPVVVSADAEFNNYIMLQEGRAVEMWYLDTLSKFFGLDTEWLKALGLIHKYIRSITLNHFGAEALRERFLPFIEASSMEALHSWSTQPSVEVKNASALMVFRTSVNKMFGEDAKKLSGNIPGKFTKLLGGFLSLPLNFPGTTYHKCLKDMKEIQKKLREVVDDRLANVGPDVEDFLGQAFKDKESEKFISEEFIIQLLFSISFASFESISTTLTLILKLLDEHPEVVKELEVEHEAIRKARADPDGPITWEEYKSMTFTLQVINETLRLGSVTPALLRKTVKDLQVKGKIIPEGWTIMLVTASRHRDPKVYKDPHIFNPWRWKDLDSITIQKNFMPFGGGLRHCAGAEYSKVYLCTFLHILCTKYRWTKLGGGTIARAHILSFEDGLHVKFTPKE

SEQ ID NO: 74 - protein, 474 aa, Cucumis melo
MWTILLGLATLAIAYYIHWVNKWKDSKFNGVLPPGTMGLPLIGETIQLSRPSDSLDVHPFIQSKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQPSVEVKESAAAMVFRTSIVKMFSEDSSKLLTAGLTKKFTGLLGGFLTLPLNVPGTTYHKCIKDMKEIQKKLKDILEERLAKGVSIDEDFLGQAIKDKESQQFISEEFIIQLLFSISFASFESISTTLTLILNFLADHPDVAKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQRNFMPFGGGLRHCAGAEYSKVYLCTFLHILFTKYRWRKLKGGKIARAHILRFEDGLYVNFTPKE

SEQ ID NO: 75 - protein, 474 aa, Cucurbita maxima
MWTIVVGLATLAVAYYIHWINKWKDSKFNGVLPPGTMGLPLIGETLQLSRPSDSLDVHPFIKKKVKRYGSIFKTCLAGRPVVVSTDAEFNNYIMLQEGRAVEMWYLDTLSKFFGLDTEWLKALGFIHKYIRSITLNHFGAESLRERFLPRIEESAKETLCYWATQPSVEVKDSAAVMVFRTSMVKMVSKDSSKLLTGGLTKKFTGLLGGFLTLPINVPGTTYNKCMKDMKEIQKKLREILEGRLASGAGSDEDFLGQAVKDKGSQKFISDDFIIQLLFSISFASFESISTTLTLILNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHMKFTPKE

SEQ ID NO: 76 - protein, 474 aa, Cucumis sativus
MWTILLGLATLAIAYYIHWVNKWKDSKFNGVLPPGTMGLPLIGETIQLSRPSDSLDVHPFIQRKVKRYGPIFKTCLAGRPVVVSTDAEFNHYIMLQEGRAVEMWYLDTLSKFFGLDTEWLKALGLIHKYIRSITLNHFGAESLRERFLPRIEESARETLHYWSTQTSVEVKESAAAMVFRTSIVKMFSEDSSKLLTEGLTKKFTGLLGGFLTLPLNLPGTTYHKCIKDMKQIQKKLKDILEERLAKGVKIDEDFLGQAIKDKESQQFISEEFIIQLLFSISFASFESISTTLTLILNFLADHPDVVKELEAEHEAIRKARADPDGPITWEEYKSMNFTLNVICETLRLGSVTPALLRKTTKEIQIKGYTIPEGWTVMLVTASRHRDPEVYKDPDTFNPWRWKELDSITIQKNFMPFGGGLRHCAGAEYSKVYLCTFLHILFTKYRWRKLKGGKIARAHILRFEDGLYVNFTPKE

SEQ ID NO: 77 - protein, 474 aa, Cucurbita moschata
MWAIVVGLATLAVAYYIHWINKWKDSKFNGVLPPGTMGLPLVGETLQLARPSDSLDVHPFIKKKVKRYGSIFKTCLAGRPVVVSTDAEFNNYIMLQEGRAVEMWYLDTLSKFFGLDTEWLKALGFIHKYIRSITLNHFGAESLRERFLPRIEESAKETLRYWATQPSVEVKDSAAVMVFRTSMVKMVSEDSSKLLTGGLTKKFTGLLGGFLTLPINVPGTTYNKCMKDMKEIQKKLREILEGRLASGAGSDEDFLGQAIKDKGSQQFISDDFIIQLLFSISFASFESISTTLTLVLNYLADHPDVVKELEAEHEAIRNARADPDGPITWEEYKSMTFTLHVIFETLRLGSVTPALLRKTTKELQINGYTIPEGWTVMLVTASRHRDPAVYKDPHTFNPWRWKELDSITIQKNFMPFGGGLRHCAGAEYSKVYLCTFLHILFTKYRWTKLKGGKVARAHILSFEDGLHVKFTPKE

SEQ ID NO: 78 - protein, 476 aa, Prunus avium
MWTLVGLSLVALLVIYFTHWIIKWRNPKCNGVLPPGSMGLPLIGETLNLIIPSYSLDLHPFIKKRLQRYGPIFRTSLAGRPVVVTADPEFNNYIFQQEGRMVELWYLDTFSKIFVHEGDSKTNAIGMVHKYVRSIFLNHFGAERLKEKLLPQIEEFVNKSLCAWSSKASVEVKHAGSVMVFNFSAKQMISYDAEKSSDDLSEKYTKIIDGLMSFPLNIPGTAYYNCSKHQKNVTTMLRDMLKERRISPETRRGDFLDQLSIDMEKEKFLSEDFSVQLVFGGLFATFESISAVIALAFSLLADHPSVVEELTAEHEAILKNRENPNSSITWDEYKSMTFTLQVINEILRLGNVAPGLLRRALKDIPVKGFTIPEGWTIMVVTSALQLSPNTFEDPLEFNPWRWKDLDSYAVSKNFMPFGGGMRQCAGAEYSRVFLATFLHVLVTKYRWTTIKAARIARNPILGFGDGIHIKFEEKKT

SEQ ID NO: 79 - protein, 474 aa, Populus trichocarpa
MWAIGLVVVALVVIYYTHMIFKWRSPKIEGVLPPGSMGWPLIGETLQFISPGKSLDLHPFVKKRMEKYGPIFKTSLVGRPIIVSTDYEMNKYILQHEGTLVELWYLDSFAKFFALEGETRVNAIGTVHKYLRSITLNHFGVESLKESLLPKIEDMLHTNLAKWASQGPVDVKQVISVMVFNFTANKIFGYDAENSKEKLSENYTKILNSFISLPLNIPGTSFHKCMQDREKMLKMLKDTLMERLNDPSKRRGDFLDQAIDDMKTEKFLTEDFIPQLMFGILFASFESMSTTLTLTFKFLTENPRVVEELRAEHEAIVKKRENPNSRLTWEEYRSMTFTQMVVNETLRISNIPPGLFRKALKDFQVKGYTVPAGWTVMLVTPATQLNPDTFKDPVTFNPWRWQELDQVTISKNFMPFGGGTRQCAGAEYSKLVLSTFLHILVTNYSFTKIRGGDVSRTPIISFGDGIHIKFTARA

SEQ ID NO: 80 - protein, 476 aa, Prunus persica
MWTLVGLSLVGLLVIYFTHWIIKWRNPKCNGVLPPGSMGLPFIGETLNLIIPSYSLDLHPFIKKRLQRYGPIFRTSLAGRQVVVTADPEFNNYLFQQEGRMVELWYLDTFSKIFVHEGESKTNAVGMVHKYVRSIFLNHFGAERLKEKLLPQIEEFVNKSLCAWSSKASVEVKHAGSVMVFNFSAKQMISYDAEKSSDDLSEKYTKIIDGLMSFPLNIPGTAYYNCLKHQKNVTTMLRDMLKERQISPETRRGDFLDQISIDMEKEKFLSEDFSVQLVFGGLFATFESISAVLALAFSLLAEHPSVVEELTAEHEAILKNRENLNSSLTWDEYKSMTFTLQVINEILRLGNVAPGLLRRALKDIPVKGFTIPEGWTIMVVTSALQLSPNTFEDPLEFNPWRWKDLDSYAVSKNFMPFGGGMRQCAGAEYSRVFLATFLHVLVTKYRWTTIKAARIARNPILGFGDGIHIKFEEKKT

SEQ ID NO: 81 - protein, 476 aa, Populus euphratica
MWTFVLCVVAVLVVYYTHWINKWRNPTCNGVLPPGSMGLPIIGETLELIIPSYSLDLHPFIKKRIQRYGPIFRTNILGRPAVVSADPEINSYIFQNEGKLVEMWYMDTFSKLFAQSGESRTNAFGIIHKYARSLTLTHFGSESLKERLLPQVENIVSKSLQMWSSDASVDVKPAVSIMVCDFTAKQLFGYDAENSSDKISEKFTKVIDAFMSLPLNIPGTTYHKCLKDKDSTLSILRNTLKERMNSPAESRGGDFLDQIIADMDKEKFLTEDFTVNLIFGILFASFESISAALTLSLKLIGDHPSVLEELTVEHEAILKNRENPDSPLTWAEYNSMTFSLQVINETLRLGNVAPGLLRRALQDMQVKGYTIPAGWVIMVVNSALHLNPATFKDPLEFNPWRWKDFDSYAVSKNLMPFGGGRRQCAGSEFTKLFMAIFLHKLVTKYRWNIIKQGNIGRNPILGFGDGIHISFSPKDI

SEQ ID NO: 82 - protein, 475 aa, Juglans regia
MWKVGLCVVGVIVVWFTRWINKWRNPKCNGILPPGSMGPPLIGESLQLIIPSYSLDLHPFIKKRVQRYGPIFRTSVVGQPMVVSTDVEFNHYLAKQEGRLVHFWYLDSFAEIFNLEDENAISAVGLIHKYGRSIVLNHFGTDSLKKTLLSQIEEIVNKTLQTWSSLPSVEVKHAASVMAFDLTAKQCFGYDVENSAVKMSEKFLYTLDSLISFPFNIPGTVYHKCLKDKKEVLNMLRNIVKERMNSPEKYRGDFLDQITADMNKESFLTQDFIVYLLYGLLFASFESISASLSLTLKLLAEHPAVLQQLTAEHEAILKNRDNPNSSLTWDEYKSMTFTFQVINEALRLGNVAPGLLRRALKDIEFKGYTIPAGWTIMLANSAIQLNPNTYEDPLAFNPWRWQDLDPQIVSKNFMPFGGGIRQCAGAEYSKTFLATFLHVLVTKYRWTKVKGGKMARNPILWFADGIHINFALKHN

SEQ ID NO: 83 - protein, 476 aa, Pyrus x bretschneideri
MWDVVGLSFVALLVIYLTYWITQWKNPKCNGVLPPGSMGLPLIGETLNLLIPSYSLDLHPFIRKRLERYGPIFRTSLAGKPVLVSADPEFNNYVLKQEGRMVEFWYLDTFSKIFMQEGGNGTNQIGVIHKYARSIFLNHFGAECIKEKLLTQIEGSINKHLRAWSNQESVEVKKAGSIMALNFCAEHMIGYDAETATENLGEIYHRVFQGLISFPLNVPGTAYHNCLKIHKKATTMLRAMLRERRSSPEKRRGDFLDQIIDDLDQEKFLSEDFCIHLIFGGLFAIFESISTVLTLFFSLLADHPAVLQELTAEHEALLKNREDPNSALTWDEYKSMTFTLQVINETLRLVNTAPGLLRRALKDIPVKGYTIPAGWTILLVTPALHLTSNTFKDHLEFNPWRWKDLDSLVISKNFMPFGSGLRQCAGAEFSRAYLSTFLHVLVTKYRWTTIKGARISRRPMLTFGDGAHIKFSEKKN

SEQ ID NO: 84 - protein, 475 aa, Morus notabilis
MWNTICLSVVGLVVIWISNWIRRWRNPKCNGVLPPGSMGFPLIGETLPLIIPTYSLDLHPFIKNRLQRYGSIFRTSIVGRPVVISADPEFNNFLFQQEGSLVELYYLDTFSKIFVHEGVSRTNEFGVVHKYIRSIFLNHFGAERLKEKLLPEIEQMVNKTLSAWSTQASVEVKHAASVLVLDFSAKQIISYDAKKSSESLSETYTRIIQGFMSFPLNIPGTAYNQCVKDQKKIIAMLRDMLKERRASPETNRGDFLDQISKDMDKEKFLSEDFVVQLIFGGLFATFESVSAVLALGFMLLSEHPSVLEEMIAEHETILKNREHPNSLLAWGEYKSMTFTLQVINETLRLGNVAPGLLRKALKDIRVKGFTIPKGWAIMMVTSALQLSPSTFKNPLEFNPWRWKDLDSLVISKNFMPFGRGMRQCAGAEYSRAFMATFFHVLLTKYRWTTIKVGNVSRNPILRFGNGIHIKFSKKN

SEQ ID NO: 85 - protein, 475 aa, Jatropha curcas
MWIIGLCFASLLVIYCTHFFYKWRNPKCKGVLPPGSMGLPIIGETLQLIIPSYSLDHHPFIQKRIQRYGPIFRTNLVGRPVIVSADPEVNQYIFQQEGNSVEMWYLDAYAKIFQLDGESRLSAVGRVHKYIRSITLNNFGIENLKENLLPQIQDLVNQSLQKWSNKASVDVKQAASVMVFNLTAKQMFSYGVEKNSSEEMTEKFTGIFNSLMSLPLNIPGTTYHKCLKDREAMLKMLRDTLKQRLSSPDTHRGDFLDQAIDDMDTEKFLTGDCIPQLIFGILLAGFETTATTLTLAFKFLAEHPLVLEELTAEHEKILSKRENLESPLTWDEYKSMTFTHHVINETLRLANFLPGLLRKALKDIQVKNYTIPAGWTIMVVKSAMQLNPEIYKDPLAFNPWRWKDLDSYTVSKNFMPFGGGSRQCAGADYSKLFMTIFLHVLVTKYRWRKIKGGDIARNPILGFGDGLHIEVSAKN

SEQ ID NO: 86 - protein, 475 aa, Hevea brasiliensis
MLTVVLLLVGFFIIYYTYWISKWRNPNCNGVLPPGSMGFPLIGETLQLLIPSYSLDLHPFIKKRIHRYGPIFRSNLAGRPVIVSADPEFNYYILSQEGRSVEIWYLDTFSKLFRQQGESRTNVAGYVHKYLRGAFLSQIGSENLREKLLLHIQDMVNRTLCSWSNQESVEVKHSASLAVCDFTAKVLFGYDAEKSPDNLSETFTRFVEGLISFPLNIPRTAYRQCLQDRQKALSILKNVLTDRRNSVENYRGDVLDLLLNDMGKEKFLTEDFICLIMLGGLFASFESISTITTLLLKLFSAHPEVVQELEAEHEKILVSRHGSDSLSITWDEYKSMTFTHQVINETLRLGNVAPGLLRRAIKDVQFKGYTIPSGWTIMMVTSAQQVNPEVYKDPLVFNPWRWKDFDSITVSKNFTPFGGGTRQCVGAEYSRLTLSLFIHLLVTKYRWTKIKEGEIRRAPMLGFGDGIHFKFSEKE

SEQ ID NO: 87 - protein, 498 aa, Jatropha curcas
MKRAIYICLARITKQGLSLIEMLMTELLFGAFFIIFLTYWINRWRNPKCNGVLPPGSMGLPLLGETLQLLIPRYSLDLHPFIRKRIQRYGPIFRSNVAGRPIVFTADPELNHYIFIQERRLVELWYMDTFSNLFVLDGESRPTGATGYIHKYMRGLFLTHFGAERLKDKLLHQIQELIHTTLQSWCKQPTIEVKHAASAVICDFSAKFLFGYEAEKSPFNMSERFAKFAESLVSFPLNIPGTAYHQSLEDREKVMKLLKNVLRERRNSTKKSEEDVLKQILDDMEKENFITDDFIIQILFGALFAISESIPMTIALLVKFLSAQPSVVEELTAEHEEILKNKKEKGLDSSITWEDYKSMTFTLQVINETLRIANVAPGLLRRTLRDIHYKGYTIPAGWTIMVLTSSRHMNPEIYKDPVEFNPWRWKDLDSQTISKNFTPFGGGTRQCAGAEYSRAFISMFLHVLVTKYRWKNVKEGKICRGPILRIEDGIHIKLYEKH

SEQ ID NO: 88 - protein, 476 aa, Chenopodium quinoa
MWPTMGLYVATIVAICFILLELKRRNSREKQVVLPPGSKGFPLIGETLQLLVPSYSLDLPSFIRTRIQRYGPIFKTRLVGRPVVMSADPGFNRYIVQQEGKSVEMWYLDTFSKLFAQDGEARTTAAGLVHKYLRNLTLSHFGSESLRVNLLPHLESLVRNTLLGWSSKDTIDVKESALTMTIEFVAKQLFGYDSDKSKEKIGEKFGNISQGLFSLPLNIPGTTYHSCLKSQREVMDMMRTALKDRLTTPESYRGDFLDHALKDLSTEKFLSEEFILQIMFGLLFASSESTSMTLTLVLKLLSENPHVLKELEAEHERIIKNKESPDSPLTWAEVKSMTFTLQVINESLRLGNVSLGILRRTLKDIEINGYTIPAGWTIMLVTSACQYNSDIYKDPLTFNPWRWKEMQPDVIAKNFMPFGGGTRQCAGAEFAKVLMTIFLHNLVTNYRWEKIKGGEIVRTPILGFRNALRVKLTKKN

SEQ ID NO: 89 - protein, 448 aa, Spinacia oleracea
MVLLPGSKGFPFIGETLQLLLPSYSLDLPSFIRTRIQRYGPIFQTRLVGRPVVVSADPGFNRYIVQQEGKMVEMWYLDTFSKIFAQQGEGRTNAAGLVHKYLRNITFTHFGSQTLRDKLLPHLEILVRKTLHGWTSQESIDVKEAALTMTIEFVAKQLFGYDSDKSKERIGDKFANISQGLLSFPLNIPGTTYHSCLKSQREVMDMMRKTLKERLASPDTCQGDFLDHALKDLNTDKFLTEDFILQIMFGLLFASSESTSITLTLILKFLSENPHVLEELEVEHERILKNRESPDSPLTWAEVKSMTFTLQVINESLRLGNVSLGLLRRTLKDIEINGYTIPAGWTIMLVTSACQYNSDVYKDPLTFNPWRWKEMQPDVIAKNFMPFGGGTRQCAGAEFAKVLMTIFLHVLVTTYRWEKIKGGEIIRTPILGFRNGLHVKLIKKARLS

SEQ ID NO: 90 - protein, 477 aa, Manihot esculenta
MEMWSVWLYIISLIIIIATHWIYRWRNPKCNGKLPPGSMGIPFIGETIQFLIPSKSLDVPNFIKKRMNKYGPLFRTNLVGRPVIVSSDPDFNYYLLQREGKLVERWYMDSFSKLLHHDVTQIIIKHGSIHKYLRNLVLGHFGPEPLKDKLLPQLESAISQRLQDWSKQPSIEAKSASSAMIFDFTAKILFSYEPEKSGENIGEIFSNFLQGLMSIPLNIPGTAFHRCLKNQKRAIQMITEILKERRSNPEIHKGDFLDQIVEDMKKDSFWTEEFAIYMMFGLLLASFETISSTLALAIIFLTDNPPVVQKLTEEHEAILKARENRDSGLSWKEYKSLSYTHQVVNESLRLASVAPGILRRAITDIQVDGYTIPKGWTIMVVPAAVQLNPNTFEDPLVFNPSRWEDMGAVAMAKNFIAFGGGSRSCAGAEFSRVLMSVFVHVFVTNYRWTKIKGGDMVRSPALGFGNGFHIRVSEKQL

SEQ ID NO: 91 - protein, 474 aa, Olea europaea var. sylvestris
MAALDLSTVGYLIVGLLTVYITHWIYKWRNPKCNGVLPPGSMGLPLIGETIQLVIPNASLDLPPFIKKRMKRYGPIFRTNVAGRPVIITADPEFNHFLLRQDGKLVDTWSMDTFAEVFDQASQSSRKYTRHLTLNHFGVEALREKLLPQMEDMVRTTLSNWSSQESVEVKSASVTMAIDYAARQIYSGNLENAPLKISDLFRDLVDGLMSFPINIPGTAHHRCLQTHKKVREMMKDIVKTRLEEPERQYGDMLDHMIEDMKKESFLDEDFIVQLMFGLFFVTSDSISTTLALAFKLLAEHPLVLEELTAEHEAILKKREKSESHLTWNDYKSMTFTLQVINEVLRLGNIAPGFFRRALQDIPVNGYTIPSGWVIMIATAGLHLNSNQFEDPLKFNPWRWKVCKVSSVIAKCFMPFGSGMKQCAGAEYSRVLLATFIHVLTTKYRWAIVKGGKIVRSPIIRFPDGFHYKIIEKTN

SEQ ID NO: 92 - protein, 711 aa, Stevia rebaudiana
MAQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 93 - protein, 693 aa, Arabidopsis thaliana
MATSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKVIDLDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 94 - protein, 712 aa, Arabidopsis thaliana
MASSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDINMANGNGYTVFDAQHPYKANVAVKRELHTPESDRSCIHLEFDIAGSGLTYETGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSENCSSAPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 95 - protein, 713 aa, Arabidopsis thaliana
MASSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 96 - protein, 710 aa, Stevia rebaudiana
MAQSESVEASTIDLMTAVLKDTVIDTANASDNGDSKMPPALAMMFEIRDLLLILTTSVAVLVGCFVVLVWKRSSGKKSGKELEPPKIVVPKRRLEQEVDDGKKKVTIFFGTQTGTAEGFAKALFEEAKARYEKAAFKVIDLDDYAADLDEYAEKLKKETYAFFFLATYGDGEPTDNAAKFYKWFTEGDEKGVWLQKLQYGVFGLGNRQYEHFNKIGIVVDDGLTEQGAKRIVPVGLGDDDQSIEDDFSAWKELVWPELDLLLRDEDDKAAATPYTAAIPEYRVVFHDKPDAFSDDHTQTNGHAVHDAQHPCRSNVAVKKELHTPESDRSCTHLEFDISHTGLSYETGDHVGVYCENLIEVVEEAGKLLGLSTDTYFSLHIDNEDGSPLGGPSLQPPFPPCTLRKALTNYADLLSSPKKSTLLALAAHASDPTEADRLRFLASREGKDEYAEWVVANQRSLLEVMEAFPSARPPLGVFFAAVAPRLQPRYYSISSSPKMEPNRIHVTCALVYEKTPAGRIHKGICSTWMKNAVPLTESQDCSWAPIFVRTSNFRLPIDPKVPVIMIGPGTGLAPFRGFLQERLALKESGTELGSSILFFGCRNRKVDYIYENELNNFVENGALSELDVAFSRDGPTKEYVQHKMTQKASEIWNMLSEGAYLYVCGDAKGMAKDVHRTLHTIVQEQGSLDSSKAELYVKNLQMSGRYLRDVW

SEQ ID NO: 97 - protein, 708 aa, Stevia rebaudiana
MAQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYFSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 98 - protein, 705 aa, Artemisia annua
MAQSTTSVKLSPFDLMTALLNGKVSFDTSNTSDTNIPLAVFMENRELLMILTTSVAVLIGCVVVLVWRRSSSAAKKAAESPVIVVPKKVTEDEVDDGRKKVTVFFGTQTGTAEGFAKALVEEAKARYEKAVFKVIDLDDYAAEDDEYEEKLKKESLAFFFLATYGDGEPTDNAARFYKWFTEGEEKGEWLDKLQYAVFGLGNRQYEHFNKIAKVVDEKLVEQGAKRLVPVGMGDDDQCIEDDFTAWKELVWPELDQLLRDEDDTSVATPYTAAVAEYRVVFHDKPETYDQDQLTNGHAVHDAQHPCRSNVAVKKELHSPLSDRSCTHLEFDISNTGLSYETGDHVGVYVENLSEVVDEAEKLIGLPPHTYFSVHADNEDGTPLGGASLPPPFPPCTLRKALASYADVLSSPKKSALLALAAHATDSTEADRLKFLASPAGKDEYAQWIVASHRSLLEVMEAFPSAKPPLGVFFASVAPRLQPRYYSISSSPRFAPNRIHVTCALVYEQTPSGRVHKGVCSTWMKNAVPMTESQDCSWAPIYVRTSNFRLPSDPKVPVIMIGPGTGLAPFRGFLQERLAQKEAGTELGTAILFFGCRNRKVDFIYEDELNNFVETGALSELVTAFSREGATKEYVQHKMTQKASDIWNLLSEGAYLYVCGDAKGMAKDVHRTLHTIVQEQGSLDSSKAELYVKNLQMAGRYLRDVW

SEQ ID NO: 99 - protein, 706 aa, Artificial Sequence
  Synthetic (CPR (PgCPR))
MAQSSSGSMSPFDFMTAIIKGKMEPSNASLGAAGEVTAMILDNRELVMILTTSIAVLIGCVVVFIWRRSSSQTPTAVQPLKPLLAKETESEVDDGKQKVTIFFGTQTGTAEGFAKALADEAKARYDKVTFKVVDLDDYAADDEEYEEKLKKETLAFFFLATYGDGEPTDNAARFYKWFLEGKERGEWLQNLKFGVFGLGNRQYEHFNKIAIVVDEILAEQGGKRLISVGLGDDDQCIEDDFTAWRESLWPELDQLLRDEDDTTVSTPYTAAVLEYRVVFHDPADAPTLEKSYSNANGHSVVDAQHPLRANVAVRRELHTPASDRSCTHLEFDISGTGIAYETGDHVGVYCENLAETVEEALELLGLSPDTYFSVHADKEDGTPLSGSSLPPPFPPCTLRTALTLHADLLSSPKKSALLALAAHASDPTEADRLRHLASPAGKDEYAQWIVASQRSLLEVMAEFPSAKPPLGVFFASVAPRLQPRYYSISSSPRIAPSRIHVTCALVYEKTPTGRVHKGVCSTWMKNSVPSEKSDECSWAPIFVRQSNFKLPADAKVPIIMIGPGTGLAPFRGFLQERLALKEAGTELGPSILFFGCRNSKMDYIYEDELDNFVQNGALSELVLAFSREGPTKEYVQHKMMEKASDIWNLISQGAYLYVCGDAKGMARDVHRTLHTIAQEQGSLDSSKAESMVKNLQMSGRYLRDVW

SEQ ID NO: 100 - protein, 348 aa, Acetobacter pasteurianus subsp. ascendens
MSVSKTTETFTSIPVIDISKLYSSDLAERKAVAEKLGDAARNIGFLYISGHNVSADLIEGVRKAARDFFAEPFEKKMEYYIGTSATHKGFVPEGEEVYSAGRPDHKEAFDIGYEVPANHPLVQAGTPLLGPNNWPDIPGFRSAAEAYYRTVFDLGRTLFRGFALALGLNESYFDTVANFPPSKLRMIHYPYDADAQDAPGIGAHTDYECFTILLADKPGLEVMNGNGDWIDAPPIPGAFVVNIGDMLEVMTAGEFVATAHRVRKVSEERYSFPLFYACDYHTQIRPLPAFAKKIDASYETITIGEHMWAQALQTYQYLVKKVEKGELKLPKGARKTATFGHFKRNSAA

SEQ ID NO: 101 - protein, 321 aa, Cucurbita maxima
MAAASSFSAAFYSGIPLIDLSAPDAKQLIVKACEELGFFKVVKHGVPMELISSLESESTKFFSLPLSEKQRAGPPSPFGYGNKQIGRNGDVGWVEYLLLNTHLESNSDGFLSMFGQDPQKLRSAVNDYISAVRNMAGEILELMAEGLKIQQRNVFSKLVMDEQSDSVFRVNHYPPCPDLQALKGTNMIGFGEHTDPQIISVLRSNNTSGFQISLADGNWISVPPDHSSFFINVGDSLQVMTNGRFKSVKHRVLTNSSKSRVSMIYFGGPPLSEKIAPLASLMQGEERSLYKEFTWFEYKRSAYNSRLADNRLVPFERIAAS

SEQ ID NO: 102 - protein, 353 aa, Dendrobium catenatum
MPSLSKEHFDLYSAFHVPETHAWSSSHLHDHPIAGDGATIPVIDISDPDAASMVGGACRSWGVFYATSHGIPADLLHQVESHARRLFSLPLHRKLQTAPRDGSLSGYGRPPISAFFPKLMWSEGFTLAGHDDHLAVTSQLSPFDSLSFCEVMEAYRKEMKKLAGRLFRLLILSLGLEEEEMGQVGPLKELSQAADAIQLNSYPTCPEPERAIGMAAHTDSAFLTVLHQTDGAGGLQVLRDQDESGSARWVDVLPRPDCLVVNVGDLLHILSNGRFKSVRHRAVVNRADHRISAAYFIGPPAHMKVGSITKLVDMRTGPMYRPVTWPEYLGIRTRLFDKALDSVKFQEKELEKD

SEQ ID NO: 103 - protein, 377 aa, Cucurbita maxima
MATTIADVFKSFPVHIPAHKNLDFDSLHELPDSYAWIQPDSFPSPTHKHHNSILDSDSDSVPLIDLSLPNAAALIGNAFRSWGAFQVINHGVPISLLQSIESSADTLFSLPPSHKLKAARTPDGISGYGLVRISSFFPKRMWSEGFTIVGSPLDHFRQLWPHDYHKHCEIVEEYDREMRSLCGRLMWLGLGELGITRDDMKWAGPDGDFKTSPAATQFNSYPVCPDPDRAMGLGPHTDTSLLTIVYQSNTRGLQVLREGKRWVTVEPVAGGLVVQVGDLLHILTNGLYPSALHQAVVNRTRKRLSVAYVFGPPESAEISPLKKLLGPTQPPLYRPVTWTEYLGKKAEHFNNALSTVRLCAPITGLLDVNDHSRVKVG

SEQ ID NO: 104 - protein, 378 aa, Cucurbita maxima
MHVVTSTPEARHDGAPLVFDASVLRHQHNIPKQFIWPDEEKPAATCPELEVPLIDLSGFLSGEKDAAAEAVRLVGEACEKHGFFLVVNHGVDRKLIGEAHKYMDEFFELPLSQKQSAQRKAGEHCGYASSFTGRFSSKLPWKETLSFRFAADESLNNLVLHYLNDKLGDQFAKFGRVYQDYCEAMSGLSLGIMELLGKSLGVEEQCFKNFFKDNDSIMRLNFYPPCQKPHLTLGTGPHCDPTSLTILHQDQVGGLQVFVDNQWRLITPNFDAFVVNIGDTFMALSNGRYKSCLHRAVVNSERTRKSLAFFLCPRNDKVVRPPRELVDTQNPRRYPDFTWSMLLRFTQTHYRADMKTLEAFSAWLQQEQQEQQEQQFNI

SEQ ID NO: 105 - protein, 361 aa, Agapanthus praecox subsp. orientalis
MVLQPFVFDAALLRDEHNIPTQFIWPEEDKPSPDASEELILPFIDLKAFLSGDPDSPFQVSKQVGEACESLGAFQVTNHGIDFDLLEEAHSCIQKFFSMPLCEKQRALRKAGESYGYASSFTGRFCSKLPWKETLSFRYSSSSSDIVQNYFVRTLGEEFRHFGEVYQKYCESMSKLSLMIMEVLGLSLGVGRMHFREFFEGNDSTMRLNYYPPCKKPDLTLGTGPHCDPTSLTILHQDDVSGLQVFTGGKWLTVRPKTDAFVVNIGDTFTALSNGRYKSCLHRAVVNSKTARKSLAFFLCPAMNKIVRPPRELVDIDHPRAYPDFTWSALLEFTQKHYRADMQTLNEFSKYILQAQGTLHK

SEQ ID NO: 106 - protein, 358 aa, Arabidopsis thaliana
MAPGTLTELAGESKLNSKFVRDEDERPKVAYNVFSDEIPVISLAGIDDVDGKRGEICRQIVEACENWGIFQVVDHGVDTNLVADMTRLARDFFALPPEDKLRFDMSGGKKGGFIVSSHLQGEAVQDWREIVTYFSYPVRNRDYSRWPDKPEGWVKVTEEYSERLMSLACKLLEVLSEAMGLEKESLTNACVDMDQKIVVNYYPKCPQPDLTLGLKRHTDPGTITLLLQDQVGGLQATRDNGKTWITVQPVEGAFVVNLGDHGHFLSNGRFKNADHQAVVNSNSSRLSIATFQNPAPDATVYPLKVREGEKAILEEPITFAEMYKRKMGRDLELARLKKLAKEERDHKEVDKPVDQIFA

SEQ ID NO: 107 - protein, 376 aa, Chrysosplenium americanum
QEKTLNSRFVARDEDSLERPKVSAIYNGSFDEIPVLISLAGIDMTGAGTDAAARRSEICRKIVEACEDWGIFGEIDDDHGKRAEICDKIVKACEDWGVFQPDEKLESVMSAAKKGDFVVDHGVDAEVISQWTTFAKPTSHTQFETETTRDFPNKPEGWKATTEQYSRTLMGLACKLLGVISEAMGLEKEALTKACVDMDQKVVVNYYPKCPQPDLTLGLKRHTDPGTITLLLQDQVGGLQATRDGGKTWITVQPVKDNGWILLHIGDSNGHRHGHFLSNGRFKSHQAYRYRRPTRGSPTFGTKVSNYPPCPEQSLVRPPAGRPYGRALNALDAKKLASAKQQLESAAILLISELAVAYIILAILPSSEIIAEEGYL

SEQ ID NO: 108 - protein, 347 aa, Datura stramonium
MATFVSNWSTNNVSESFIAPLEKRAEKDVALGNDVPIIDLQQDHLLIVQQITKACQDFGLFQVINHGVPEKLMVEAMEVYKEFFALPAEEKEKFQPKGEPAKFELPLEQKAKLYVEGERRCNEEFLYWKDTLAHGCYPLHEELLNSWPEKPPTYRDVIAKYSVEVRKLTMRILDYICEGLGLKLGYFDNELTQIQMLLANYYPSCPDPSSTIGSGGHYDGNLITLLQQDLVGLQQLIVKDDKWIAVEPIPTAFVVNLGLTLKVMSNEKFEGSIHRVVTHPTRNRISIGTLIGPDYSCTIEPIKELLSQENPPLYKPYPYAKFAEIYLSDKSDYDAGVKPYKINQFPN

SEQ ID NO: 109 - protein, 329 aa, Arabidopsis thaliana
MENHTTMKVSSLNCIDLANDDLNHSVVSLKQACLDCGFFYVINHGISEEFMDDVFEQSKKLFALPLEEKMKVLRNEKHRGYTPVLDELLDPKNQINGDHKEGYYIGIEVPKDDPHWDKPFYGPNPWPDADVLPGWRETMEKYHQEALRVSMAIARLLALALDLDVGYFDRTEMLGKPIATMRLLRYQGISDPSKGIYACGAHSDFGMMTLLATDGVMGLQICKDKNAMPQKWEYVPPIKGAFIVNLGDMLERWSNGFFKSTLHRVLGNGQERYSIPFFVEPNHDCLVECLPTCKSESELPKYPPIKCSTYLTQRYEETHANLSIYHQQT

SEQ ID NO: 110 - protein, 511 aa, Solanum lycopersicum
MALRINELFVAAIIYIIVHIIISKLITTVRERGRRLPLPPGPTGWPVIGALPLLGSMPHVALAKMAKKYGPIMYLKVGTCGMVVASTPNAAKAFLKTLDINFSNRPPNAGATHLAYNAQDMVFAPYGPRWKLLRKLSNLHMLGGKALENWANVRANELGHMLKSMFDASQDGECVVIADVLTFAMANMIGQVMLSKRVFVEKGVEVNEFKNMVVELMTVAGYFNIGDFIPKLAWMDIQGIEKGMKNLHKKFDDLLTKMFDEHEATSNERKENPDFLDVVMANRDNSEGERLSTTNIKALLLNLFTAGTDTSSSVIEWALAEMMKNPKIFEKAQQEMDQVIGKNRRLIESDIPNLPYLRAICKETFRKHPSTPLNLPRVSSEPCTVDGYYIPKNTRLSVNIWAIGRDPDVWENPLEFTPERFLSGKNAKIEPRGNDFELIPFGAGRRICAGTRMGIVMVEYILGTLVHSFDWKLPNNVIDINMEESFGLALQKAVPLEAMVTPRLSLDVYRC

SEQ ID NO: 111 - protein, 401 aa, Artificial Sequence
  Synthetic (D4H)
MPKSWPIVISSHSFCFLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 112 - protein, 372 aa, Catharanthus roseus
MKELNNSEEELKAFDDTKAGVKALVDSGITEIPRIFLDHPTNLDQISSKDREPKFKKNIPVIDLDGISTNSEIRREIVEKIREASEKWGFFQIVNHGIPQEVMDDMIVGIRRFHEQDNEIKKQFYTRDRTKSFRYTSNFVLNPKIACNWRDTFECTMAPHQPNPQDLPDICRDIMMKYISYTRNLGLTLFELLSEALGLKSNRLKDMHCDEGVELVGHYYPACPQPELTLGTSKHTDTGFLTMLQQDQIGGLQVLYENHQWVDVPFIPGALIINIGDFLQIISNDKFKSAPHRVLANKNGPRISTASVFMPNFLESAEVRLYGPIKELLSEENPPIYEQITAKDYVTVQFSRGLDGDSFLSPFMLNKDNMEK

SEQ ID NO: 113 - protein, 374 aa, Zea mays
MAPTTATKDDSGYGDERRRELQAFDDTKLGVKGLVDSGVKSIPSIFHHPPEALSDIISPAPLPSSPPSGAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPPPREELPEPLRNVMLEYGAAVTKLARFVFELLSESLGMPSDHLYEMECMQNLNVVCQYYPPCPEPHRTVGVKRHTDPGFFTILLQDGMGGLQVRLGNNGQSGGCWVDIAPRPGALMVNIGDLLQLVTNDRFRSVEHRVPANKSSDTARVSVASFFNTDVRRSERMYGPIPDPSKPPLYRSVRARDFIAKFNTIGLDGRALDHFRL

SEQ ID NO: 114 - protein, 338 aa, Hordeum vulgare subsp. vulgare
MAKVMNLTPVHASSIPDSFLLPADRLHPATTDVSLPIIDMSRGRDEVRQAILDSGKEYGFIQVVNHGISEPMLHEMYAVCHEFFDMPAEDKAEFFSEDRSERNKLFCGSAFETLGEKYWIDVLELLYPLPSGDTKDWPHKPQMLREVVGNYTSLARGVAMEILRLLCEGLGLRPDFFVGDISGGRVVVDINYYPPSPNPSRTLGLPPHCDRDLMTVLLPGAVPGLEIAYKGGWIKVQPVPNSLVINFGLQLEVVTNGYLKAVEHRAATNFAEPRLSVASFIVPADDCVVGPAEEFVSEDNPPRYRTLTVGEFKRKHNVVNLDSSINQIININNNQKGI

SEQ ID NO: 115 - protein, 339 aa, Hordeum vulgare subsp. vulgare
MENILHATPAPVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 116 - protein, 523 aa, Siraitia grosvenorii
MEDRNAMDMSRIKYRPQPLRPASMVQPRVLLFPFPALGHVKPFLSLAELLSDAGIDVVFLSTEYNHRRISNTEALASRFPTLHFETIPDGLPPNESRALADGPLYFSMREGTKPRFRQLIQSLNDGRWPITCIITDIMLSSPIEVAEEFGIPVIAFCPCSARYLSIHFFIPKLVEEGQIPYADDDPIGEIQGVPLFEGLLRRNHLPGSWSDKSADISFSHGLINQTLAAGRASALILNTFDELEAPFLTHLSSIFNKIYTIGPLHALSKSRLGDSSSSASALSGFWKEDRACMSWLDCQPPRSVVFVSFGSTMKMKADELREFWYGLVSSGKPFLCVLRSDVVSGGEAAELIEQMAEEEGAGGKLGMVVEWAAQEKVLSHPAVGGFLTHCGWNSTVESIAAGVPMMCWPILGDQPSNATWIDRVWKIGVERNNREWDRLTVEKMVRALMEGQKRVEIQRSMEKLSKLANEKVVRGINLHPTISLKKDTPTTSEHPRHEFENMRGMNYEMLVGNAIKSPTLTKK

SEQ ID NO: 117 - protein, 473 aa, Siraitia grosvenorii
MTIFFSVEILVLGIAEFAAIAMDAAQQGDTTTILMLPWLGYGHLSAFLELAKSLSRRNFHIYFCSTSVNLDAIKPKLPSSFSDSIQFVELHLPSSPEFPPHLHTTNGLPPTLMPALHQAFSMAAQHFESILQTLAPHLLIYDSLQPWAPRVASSLKIPAINFNTTGVFVISQGLHPIHYPHSKFPFSEFVLHNHWKAMYSTADGASTERTRKRGEAFLYCLHASCSVILINSFRELEGKYMDYLSVLLNKKVVPVGPLVYEPNQDGEDEGYSSIKNWLDKKEPSSTVFVSFGSEYFPSKEEMEEIAHGLEASEVNFIWVVRFPQGDNTSGIEDALPKGFLERAGERGMVVKGWAPQAKILKHWSTGGFVSHCGWNSVMESMMFGVPIIGVPMHVDQPFNAGLVEEAGVGVEAKRDPDGKIQRDEVAKLIKEVVVEKTREDVRKKAREMSEILRSKGEEKFDEMVAEISLLLKI

SEQ ID NO: 118 - protein, 460 aa, Siraitia grosvenorii
MDETTVNGGRRASDVVVFAFPRHGHMSPMLQFSKRLVSKGLRVTFLITTSATESLRLNLPPSSSLDLQVISDVPESNDIATLEGYLRSFKATVSKTLADFIDGIGNPPKFIVYDSVMPWVQEVARGRGLDAAPFFTQSSAVNHILNHVYGGSLSIPAPENTAVSLPSMPVLQAEDLPAFPDDPEVVMNFMTSQFSNFQDAKWIFFNTFDQLECKKQSQVVNWMADRWPIKTVGPTIPSAYLDDGRLEDDRAFGLNLLKPEDGKNTRQWQWLDSKDTASVLYISFGSLAILQEEQVKELAYFLKDTNLSFLWVLRDSELQKLPHNFVQETSHRGLVVNWCSQLQVLSHRAVSCFVTHCGWNSTLEALSLGVPMVAIPQWVDQTTNAKFVADVWRVGVRVKKKDERIVTKEELEASIRQVVQGEGRNEFKHNAIKWKKLAKEAVDEGGSSDKNIEEFVKTIA

SEQ ID NO: 119 - protein, 486 aa, Siraitia grosvenorii
MGDNGDGGEKKELKENVKKGKELGRQAIGEGYINPSLQLARRLISLGVNVTFATTVLAGRRMKNKTHQTATTPGLSFATFSDGFDDETLKPNGDLTHYFSELRRCGSESLTHLITSAANEGRPITFVIYSLLLSWAADIASTYDIPSALFFAQPATVLALYFYYFHGYGDTICSKLQDPSSYIELPGLPLLTSQDMPSFFSPSGPHAFILPPMREQAEFLGRQSQPKVLVNTFDALEADALRAIDKLKMLAIGPLIPSALLGGNDSSDASFCGDLFQVSSEDYIEWLNSKPDSSVVYISVGSICVLSDEQEDELVHALLNSGHTFLWVKRSKENNEGVKQETDEEKLKKLEEQGKMVSWCRQVEVLKHPALGCFLTHCGWNSTIESLVSGLPVVAFPQQIDQATNAKLIEDVWKTGVRVKANTEGIVEREEIRRCLDLVMGSRDGQKEEIERNAKKWKELARQAIGEGGSSDSNLKTFLWEIDLEI

SEQ ID NO: 120 - protein, 485 aa, Siraitia grosvenorii
MAEQAHDLLHVLLFPFPAEGHIKPFLCLAELLCNAGFHVTFLNTDYNHRRLHNLHLLAARFPSLHFESISDGLPPDQPRDILDPKFFISICQVTKPLFRELLLSYKRISSVQTGRPPITCVITDVIFRFPIDVAEELDIPVFSFCTFSARFMFLYFWIPKLIEDGQLPYPNGNINQKLYGVAPEAEGLLRCKDLPGHWAFADELKDDQLNFVDQTTASSRSSGLILNTFDDLEAPFLGRLSTIFKKIYAVGPIHSLLNSHHCGLWKEDHSCLAWLDSRAAKSVVFVSFGSLVKITSRQLMEFWHGLLNSGKSFLFVLRSDVVEGDDEKQVVKEIYETKAEGKWLVVGWAPQEKVLAHEAVGGFLTHSGWNSILESIAAGVPMISCPKIGDQSSNCTWISKVWKIGLEMEDRYDRVSVETMVRSIMEQEGEKMQKTIAELAKQAKYKVSKDGTSYQNLECLIQDIKKLNQIEGFINNPNFSDLLRV

SEQ ID NO: 121 - protein, 473 aa, Siraitia grosvenorii
MDAQQGHTTTILMLPWVGYGHLLPFLELAKSLSRRKLFHIYFCSTSVSLDAIKPKLPPSISSDDSIQLVELRLPSSPELPPHLHTTNGLPSHLMPALHQAFVMAAQHFQVILQTLAPHLLIYDILQPWAPQVASSLNIPAINFSTTGASMLSRTLHPTHYPSSKFPISEFVLHNHWRAMYTTADGALTEEGHKIEETLANCLHTSCGVVLVNSFRELETKYIDYLSVLLNKKVVPVGPLVYEPNQEGEDEGYSSIKNWLDKKEPSSTVFVSFGTEYFPSKEEMEEIAYGLELSEVNFIWVLRFPQGDSTSTIEDALPKGFLERAGERAMVVKGWAPQAKILKHWSTGGLVSHCGWNSMMEGMMFGVPIIAVPMHLDQPFNAGLVEEAGVGVEAKRDSDGKIQREEVAKSIKEVVIEKTREDVRKKAREMDTKHGPTYFSRSKVSSFGRLYKINRPTTLTVGRFWSKQIKMKRE

SEQ ID NO: 122 - protein, 453 aa, Siraitia grosvenorii
MDAQRGHTTTILMFPWLGYGHLSAFLELAKSLSRRNFHIYFCSTSVNLDAIKPKLPSSSSSDSIQLVELCLPSSPDQLPPHLHTTNALPPHLMPTLHQAFSMAAQHFAAILHTLAPHLLIYDSFQPWAPQLASSLNIPAINFNTTGASVLTRMLHATHYPSSKFPISEFVLHDYWKAMYSAAGGAVTKKDHKIGETLANCLHASCSVILINSFRELEEKYMDYLSVLLNKKVVPVGPLVYEPNQDGEDEGYSSIKNWLDKKEPSSTVFVSFGSEYFPSKEEMEEIAHGLEASEVHFIWVVRFPQGDNTSAIEDALPKGFLERVGERGMVVKGWAPQAKILKHWSTGGFVSHCGWNSVMESMMFGVPIIGVPMHLDQPFNAGLAEEAGVGVEAKRDPDGKIQRDEVAKLIKEVVVEKTREDVRKKAREMSEILRSKGEEKMDEMVAAISLFLKI

SEQ ID NO: 123 - protein, 472 aa, Momordica charantia
MAQPQTQARVLVFPYPTVGHIKPFLSLAELLADGGLDVVFLSTEYNHRRIPNLEALASRFPTLHFDTIPDGLPIDKPRVIIGGELYTSMRDGVKQRLRQVLQSYNDGSSPITCVICDVMLSGPIEAAEELGIPVVTFCPYSARYLCAHFVMPKLIEEGQIPFTDGNLAGEIQGVPLFGGLLRRDHLPGFWFVKSLSDEVWSHAFLNQTLAVGRTSALIINTLDELEAPFLAHLSSTFDKIYPIGPLDALSKSRLGDSSSSSTVLTAFWKEDQACMSWLDSQPPKSVIFVSFGSTMRMTADKLVEFWHGLVNSGTRFLCVLRSDIVEGGGAADLIKQVGETGNGIVVEWAAQEKVLAHRAVGGFLTHCGWNSTMESIAAGVPMMCWQIYGDQMINATWIGKVWKIGIERDDKWDRSTVEKMIKELMEGEKGAEIQRSMEKFSKLANDKVVKGGTSFENLELIVEYLKKLKPSN

SEQ ID NO: 124 - protein, 466 aa, Momordica charantia
MAQPRVLLFPFPAMGHVKPFLSLAELLSDAGVEVVFLSTEYNHRRIPDIGALAARFPTLHFETIPDGLPPDQPRVLADGHLYFSMLDGTKPRFRQLIQSLNGNPRPITCIINDVMLSSPIEVAEEFGIPVIAFCPCSARFLSVHFFMPNFIEEAQIPYTDENPMGKIEEATVFEGLLRRKDLPGLWCAKSSNISFSHRFINQTIAAGRASALILNTFDELESPFLNHLSSIFPKIYCIGPLNALSRSRLGKSSSSSSALAGFWKEDQAYMSWLESQPPRSVIFVSFGSTMKMEAWKLAEFWYGLVNSGSPFLFVFRPDCVINSGDAAEVMEGRGRGMVVEWASQEKVLAHPAVGGFLTHCGWNSTVESIVAGVPMMCCPIVADQLSNATWIHKVWKIGIEGDEKWDRSTVEMMIKELMESQKGTEIRTSIEMLSKLANEKVVKGGTSLNNFELLVEDIKTLRRPYT

SEQ ID NO: 125 - protein, 482 aa, Momordica charantia
MEQSDSNSDDHQHHVLLFPFPAKGHIKPFLCLAQLLCGAGLQVTFLNTDHNHRRIDDRHRRLLATQFPMLHFKSISDGLPPDHPRDLLDGKLIASMRRVTESLFRQLLLSYNGYGNGTNNVSNSGRRPPISCVITDVIFSFPVEVAEELGIPVFSFATFSARFLFLYFWIPKLIQEGQLPFPDGKTNQELYGVPGAEGIIRCKDLPGSWSVEAVAKNDPMNFVKQTLASSRSSGLILNTFEDLEAPFVTHLSNTFDKIYTIGPIHSLLGTSHCGLWKEDYACLAWLDARPRKSVVFVSFGSLVKTTSRELMELWHGLVSSGKSFLLVLRSDVVEGEDEEQVVKEILESNGEGKWLVVGWAPQEEVLAHEAIGGFLTHSGWNSTMESIAAGVPMVCWPKIGDQPSNCTWVSRVWKVGLEMEERYDRSTVARMARSMMEQEGKEMERRIAELAKRVKYRVGKDGESYRNLESLIRDIKITKSSN

SEQ ID NO: 126 - protein, 450 aa, Momordica charantia
MDAHQQAEHTTTILMLPWVGYGHLTAYLELAKALSRRNFHIYYCSTPVNIESIKPKLTIPCSSIQFVELHLPSSDDLPPNLHTTNGLPSHLMPTLHQAFSAAAPLFEEILQTLCPHLLIYDSLQPWAPKIASSLKIPALNFNTSGVSVIAQALHAIHHPDSKFPLSDFILHNYWKSTYTTADGGASEKTRRAREAFLYCLNSSGNAILINTFRELEGEYIDYLSLLLNKKVIPIGPLVYEPNQDEDQDEEYRSIKNWLDKKEPCSTVFVSFGSEYFPSNEEMEEIAPGLEESGANFIWVVRFPKLENRNGIIEEGLLERAGERGMVIKEWAPQARILRHGSIGGFVSHCGWNSVMESIICGVPVIGVPMRVDQPYNAGLVEEAGVGVEAKRDPDGKIQRHEVSKLIKQVVVEKTRDDVRKKVAQMSEILRRKGDEKIDEMVALISLLPKG

SEQ ID NO: 127 - protein, 450 aa, Momordica charantia
MDARQQAEHTTTILMLPWVGYGHLSAYLELAKALSRRNFHIYYCSTPVNIESIKPKLTIPCSSIQFVELHLPFSDDLPPNLHTTNGLPSHLMPALHQAFSAAAPLFEAILQTLCPHLLIYDSLQPWAPQIASSLKIPALNFNTTGVSVIARALHTIHHPDSKFPLSEIVLHNYWKATHATADGANPEKFRRDLEALLCCLHSSCNAILINTFRELEGEYIDYLSLLLNKKVTPIGPLVYEPNQDEEQDEEYRSIKNWLDKKEPYSTIFVSFGSEYFPSNEEMEEIARGLEESGANFIWVVRFHKLENGNGITEEGLLERAGERGMVIQGWAPQARILRHGSIGGFVSHCGWNSVMESIICGVPVIGVPMGLDQPYNAGLVEEAGVGVEAKRDPDGKIQRHEVSKLIKQVVVEKTRDDVRKKVAQMSEILRRKGDEKIDEMVALISLLLKG

SEQ ID NO: 128 - protein, 471 aa, Cucumis sativus
MGLSPTDHVLLFPFPAKGHIKPFFCLAHLLCNAGLRVTFLSTEHHHQKLHNLTHLAAQIPSLHFQSISDGLSLDHPRNLLDGQLFKSMPQVTKPLFRQLLLSYKDGTSPITCVITDLILRFPMDVAQELDIPVFCFSTFSARFLFLYFSIPKLLEDGQIPYPEGNSNQVLHGIPGAEGLLRCKDLPGYWSVEAVANYNPMNFVNQTIATSKSHGLILNTFDELEVPFITNLSKIYKKVYTIGPIHSLLKKSVQTQYEFWKEDHSCLAWLDSQPPRSVMFVSFGSIVKLKSSQLKEFWNGLVDSGKAFLLVLRSDALVEETGEEDEKQKELVIKEIMETKEEGRWVIVNWAPQEKVLEHKAIGGFLTHSGWNSTLESVAVGVPMVSWPQIGDQPSNATWLSKVWKIGVEMEDSYDRSTVESKVRSIMEHEDKKMENAIVELAKRVDDRVSKEGTSYQNLQRLIEDIEGFKLN

SEQ ID NO: 129 - protein, 462 aa, Cucurbita maxima
MELSHTHHVLLFPFPAKGHIKPFFSLAQLLCNAGLRVTFLNTDHHHRRIHDLNRLAAQLPTLHFDSVSDGLPPDEPRNVFDGKLYESIRQVTSSLFRELLVSYNNGTSSGRPPITCVITDVMFRFPIDIAEELGIPVFTFSTFSARFLFLIFWIPKLLEDGQLRYPEQELHGVPGAEGLIRWKDLPGFWSVEDVADWDPMNFVNQTLATSRSSGLILNTFDELEAPFLTSLSKIYKKIYSLGPINSLLKNFQSQPQYNLWKEDHSCMAWLDSQPRKSVVFVSFGSVVKLTSRQLMEFWNGLVNSGMPFLLVLRSDVIEAGEEVVREIMERKAEGRWVIVSWAPQEEVLAHDAVGGFLTHSGWNSTLESLAAGVPMISWPQIGDQTSNSTWISKVWRIGLQLEDGFDSSTIETMVRSIMDQTMEKTVAELAERAKNRASKNGTSYRNFQTLIQDITNIIETHI

SEQ ID NO: 130 - protein, 454 aa, Cucurbita maxima
MDAQKAVDTPPTTVLMLPWIGYGHLSAYLELAKALSRRNFHVYFCSTPVNLDSIKPNLIPPPSSIQFVDLHLPSSPELPPHLHTTNGLPSHLKPTLHQAFSAAAQHFEAILQTLSPHLLIYDSLQPWAPRIASSLNIPAINFNTTAVSIIAHALHSVHYPDSKFPFSDFVLHDYWKAKYTTADGATSEKIRRGAEAFLYCLNASCDVVLVNSFRELEGEYMDYLSVLLKKKVVSVGPLVYEPSEGEEDEEYWRIKKWLDEKEALSTVLVSFGSEYFPSKEEMEEIAHGLEESEANFIWVVRFPKGEESCRGIEEALPKGFVERAGERAMVVKKWAPQGKILKHGSIGGFVSHCGWNSVLESIRFGVPVIGVPMHLDQPYNAGLLEEAGIGVEAKRDADGKIQRDQVASLIKRVVVEKTREDIWKTVREMREVLRRRDDDMIDEMVAEISVVLKI

SEQ ID NO: 131 - protein, 492 aa, Cucurbita maxima
MSSNLFLKISIPFGRLRDSALNCSVFHCKLHLAIAIAMDAQQAANKSPTATTIFMLPWAGYGHLSAYLELAKALSTRNFHIYFCSTPVSLASIKPRLIPSCSSIQFVELHLPSSDEFPPHLHTTNGLPSRLVPTFHQAFSEAAQTFEAFLQTLRPHLLIYDSLQPWAPRIASSLNIPAINFFTAGAFAVSHVLRAFHYPDSQFPSSDFVLHSRWKIKNTTAESPTQAKLPKIGEAIGYCLNASRGVILTNSFRELEGKYIDYLSVILKKRVFPIGPLVYQPNQDEEDEDYSRIKNWLDRKEASSTVLVSFGSEFFLSKEETEAIAHGLEQSEANFIWGIRFPKGAKKNAIEEALPEGFLERAGGRAMVVEEWVPQGKILKHGSIGGFVSHCGWNSAMESIVCGVPIIGIPMQVDQPFNAGILEEAGVGVEAKRDSDGKIQRDEVAKLIKEVVVERTREDIRNKLEKINEILRSRREEKLDELATEISLLSRN

SEQ ID NO: 132 - protein, 462 aa, Cucurbita moschata
MELSPTHHLLLFPFPAKGHIKPFFSLAQLLCNAGARVTFLNTDHHHRRIHDLDRLAAQLPTLHFDSVSDGLPPDESRNVFDGKLYESIRQVTSSLFRELLVSYNNGTSSGRPPITCVITDCMFRFPIDIAEELGIPVFTFSTFSARFLFLFFWIPKLLEDGQLRYPEQELHGVPGAEGLIRCKDLPGFLSDEDVAHWKPINFVNQILATSRSSGLILNTFDELEAPFLTSLSKIYKKIYSLGPINSLLKNFQSQPQYNLWKEDHSCMAWLDSQPPKSVVFVSFGSVVKLTNRQLVEFWNGLVNSGKPFLLVLRSDVIEAGEEVVRENMERKAEGRWMIVSWAPQEEVLAHDAVGGFLTHSGWNSTLESLAAGVPMISWTQIGDQTSNSTWVSKVWRIGLQLEDGFDSFTIETMVRSVMDQTMEKTVAELAERAKNRASKNGTSYRNFQTLIQDITNIIETHI

SEQ ID NO: 133 - protein, 457 aa, Cucurbita moschata
MDAQKAVDTPPTTVLMLPWIGYGHLSAYLELAKALSRRNFHVYFCSTPVNLDSIKPNLIPPPPSIQFVDLHLPSSPELPPHLHTTNGLPSHLKPTLHQAFSAAAQHFEAILQTLSPHLLIYDSLQPWAPRIASSLNIPAINFNTTAVSIIAHALHSVHYPDSKFPFSDFVLHDYWKAKYTTADGATSEKTRRGVEAFLYCLNASCDVVLVNSFRELEGEYMDYLSVLLKKKVVSVGPLVYEPSEGEEDEEYWRIKKWLDEKEALSTVLVSFGSEYFPPKEEMEEIAHGLEESEANFIWVVRFPKGEESSSRGIEEALPKGFVERAGERAMVVKKWAPQGKILKHGSIGGFVSHCGWNSVLESIRFGVPVIGAPMHLDQPYNAGLLEEAGIGVEAKRDADGKIQRDQVASLIKQVVVEKTREDIWKKVREMREVLRRRDDDDMMIDEMVAVISVVLKI

SEQ ID NO: 134 - protein, 455 aa, Cucurbita moschata
MDAQQAANKSPTASTIFMLPWVGYGHLSAYLELAKALSTRNFHVYFCSTPVSLASIKPRLIPSCSSIQFVELHLPSSDEFPPHLHTTNGLPAHLVPTIHQAFAAAAQTFEAFLQTLRPHLLIYDSLQPWAPRIASSLNIPAINFFTAGAFAVSHVLRAFHYPDSQFPSSDFVLHSRWKIKNTTAESPTQVKIPKIGEAIGYCLNASRGVILTNSFRELEGKYIDYLSVILKKRVLPIGPLVYQPNQDEEDEDYSRIKNWLDRKEASSTVLVSFGSEFFLSKEETEAIAHGLEQSEANFIWGIRFPKGAKKNAIEEALPEGFLERVGGRAMVVEEWVPQGKILKHGNIGGFVSHCGWNSAMESIMCGVPVIGIPMQVDQPFNAGILEEAGVGVEAKRDSDGKIQRDEVAKLIKEVVVERTREDIRNKLEEINEILRTRREEKLDELATEISLLCKN

SEQ ID NO: 135 - protein, 474 aa, Prunus persica
MAMKQPHVIIFPFPLQGHMKPLLCLAELLCHAGLHVTYVNTHHNHQRLANRQALSTHFPTLHFESISDGLPEDDPRTLNSQLLIALKTSIRPHFRELLKTISLKAESNDTLVPPPSCIMTDGLVTFAFDVAEELGLPILSFNVPCPRYLWTCLCLPKLIENGQLPFQDDDMNVEITGVPGMEGLLHRQDLPGFCRVKQADHPSLQFAINETQTLKRASALILDTVYELDAPCISHMALMFPKIYTLGPLHALLNSQIGDMSRGLASHGSLWKSDLNCMTWLDSQPSKSIIYVSFGTLVHLTRAQVIEFWYGLVNSGHPFLWVMRSDITSGDHQIPAELENGTKERGCIVDWVSQEEVLAHKSVGGFLTHSGWNSTLESIVAGLPMICWPKLGDHYIISSTVCRQWKIGLQLNENCDRSNIESMVQTLMGSKREEIQSSMDAISKLSRDSVAEGGSSHNNLEQLIEYIRNLQHQN

SEQ ID NO: 136 - protein, 468 aa, Theobroma cacao
MRQPHVLVLPFPAQGHIKPMLCLAELLCQAGLRVTFLNTHHSHRRLNNLQDLSTRFPTLHFESVSDGLPEDHPRNLVHFMHLVHSIKNVTKPLLRDLLTSLSLKTDIPPVSCIIADGILSFAIDVAEELQIKVIIFRTISSCCLWSYLCVPKLIQQGELQFSDSDMGQKVSSVPEMKGSLRLHDRPYSFGLKQLEDPNFQFFVSETQAMTRASAVIFNTFDSLEAPVLSQMIPLLPKVYTIGPLHALRKARLGDLSQHSSFNGNLREADHNCITWLDSQPLRSVVYVSFGSHVVLTSEELLEFWHGLVNSGKRFLWVLRPDIIAGEKDHNQIIAREPDLGTKEKGLLVDWAPQEEVLAHPSVGGFLTHCGWNSTLESMVAGVPMLCWPKLPDQLVNSSCVSEVWKIGLDLKDMCDRSTVEKMVRALMEDRREEVMRSVDGISKLARESVSHGGSSSSNLEMLIQELET

SEQ ID NO: 137 - protein, 462 aa, Corchorus capsularis
MDSKQKKMSVLMFPWLAYGHISPFLELAKKLSKRNFHTFFFSTPINLNSIKSKLSPKYAQSIQFVELHLPSLPDLPPHYHTTNGLPPHLMNTLKKAFDMSSLQFSKILKTLNPDLLVYDFIQPWAPLLALSNKIPAVHFLCTSAAMSSFSVHAFKKPCEDFPFPNIYVHGNFMNAKFNNMENCSSDDSISDQDRVLQCFERSTKIILVKTFEELEGKFMDYLSVLLNKKIVPTGPLTQDPNEDEGDDDERTKLLLEWLNKKSKSSTVFVSFGSEYFLSKEEREEIAYGLELSKVNFIWVIRFPLGENKTNLEEALPQGFLQRVSERGLVVENWAPQAKILQHSSIGGFVSHCGWSSVMESLKFGVPIIAIPMHLDQPLNARLVVDVGVGLEVIRNHGSLEREEIAKLIKEVVLGNGNDGEIVRRKAREMSNHIKKKGEKDMDELVEELMLICKMKPNSCHLS

SEQ ID NO: 138 - protein, 448 aa, Ziziphus jujube
MMERQRSIKVLMFPWLAHGHISPFLELAKRLTDRNFQIYFCSTPVNLTSVKPKLSQKYSSSIKLVELHLPSLPDLPPHYHTTNGLALNLIPTLKKAFDMSSSSFSTILSTIKPDLLIYDFLQPWAPQLASCMNIPAVNFLSAGASMVSFVLHSIKYNGDDHDDEFLTTELHLSDSMEAKFAEMTESSPDEHIDRAVTCLERSNSLILIKSFRELEGKYLDYLSLSFAKKVVPIGPLVAQDTNPEDDSMDIINWLDKKEKSSTVFVSFGSEYYLTNEEMEEIAYGLELSKVNFIWVVRFPLGQKMAVEEALPKGFLERVGEKGMVVEDWAPQMKILGHSSIGGFVSHCGWSSLMESLKLGVPIIAMPMQLDQPINAKLVERSGVGLEVKRDKNGRIEREYLAKVIREIVVEKARQDIEKKAREMSNIITEKGEEEIDNVVEELAKLCGM

SEQ ID NO: 139 - protein, 446 aa, Vitis vinifera
MDARQSDGISVLMFPWLAHGHISPFLQLAKKLSKRNFSIYFCSTPVNLDPIKGKLSESYSLSIQLVKLHLPSLPELPPQYHTTNGLPPHLMPTLKMAFDMASPNFSNILKTLHPDLLIYDFLQPWAPAAASSLNIPAVQFLSTGATLQSFLAHRHRKPGIEFPFQEIHLPDYEIGRLNRFLEPSAGRISDRDRANQCLERSSRFSLIKTFREIEAKYLDYVSDLTKKKMVTVGPLLQDPEDEDEATDIVEWLNKKCEASAVFVSFGSEYFVSKEEMEEIAHGLELSNVDFIWVVRFPMGEKIRLEDALPPGFLHRLGDRGMVVEGWAPQRKILGHSSIGGFVSHCGWSSVMEGMKFGVPIIAMPMHLDQPINAKLVEAVGVGREVKRDENRKLEREEIAKVIKEVVGEKNGENVRRKARELSETLRKKGDEEIDVVVEELKQLCSY

SEQ ID NO: 140 - protein, 456 aa, Juglans nigra
MDTARKRIRVVMLPWLAHGHISPFLELSKKLAKRNFHIYFCSTPVNLSSIKPKLSGKYSRSIQLVELHLPSLPELPPQYHTTKGLPPHLNATLKRAFDMAGPHFSNILKTLSPDLLIYDFLQPWAPAIAASQNIPAINFLSTGAAMTSFVLHAMKKPGDEFPFPEIHLDECMKTRFVDLPEDHSPSDDHNHISDKDRALKCFERSSGFVMMKTFEELEGKYINFLSHLMQKKIVPVGPLVQNPVRGDHEKAKTLEWLDKRKQSSAVFVSFGTEYFLSKEEMEEIAYGLELSNVNFIWVVRFPEGEKVKLEEALPEGFLQRVGEKGMVVEGWAPQAKILMHPSIGGFVSHCGWSSVMESIDFGVPIVAIPMQLDQPVNAKVVEQAGVGVEVKRDRDGKLEREEVATVIREVVMGNIGESVRKKEREMRDNIRKKGEEKMDGVAQELVQLYGNGIKNV

SEQ ID NO: 141 - protein, 456 aa, Hevea brasiliensis
METLQRRKISVLMFPWLAHGHLSPFLELSKKLNKRNFHVYFCSTPVNLDSIKPKLSAEYSFSIQLVELHLPSSPELPLHYHTTNGLPPHLMKNLKNAFDMASSSFFNILKTLKPDLLIYDFIQPWAPALASSLNIPAVNFLCTSMAMSCFGLHLNNQEAKFPFPGIYPRDYMRMKVFGALESSSNDIKDGERAGRCMDQSFHLILAKTFRELEGKYIDYLSVKLMKKIVPVGPLVQDPIFEDDEKIMDHHQVIKWLEKKERLSTVFVSFGTEYFLSTEEMEEIAYGLELSKAHFIWVVRFPTGEKINLEESLPKRYLERVQERGKIVEGWAPQQKILRHSSIGGFVSHCGWSSIMESMKFGVPIIAMPMNLDQPVNSRIVEDAGVGIEVRRNKSGELEREEIAKTIRKVVVEKDGKNVSRKAREMSDTIRKKGEEEIDGVVDELLQLCDVKTNYLQ

SEQ ID NO: 142 - protein, 461 aa, Manihot esculenta
MATAQTRKISVLMFPWLAHGHLSPFLELSKKLANRNFHVYFCSTPVNLDSIKPKLSPEYHFSIQFVELHLPSSPELPSHYHTTNGLPPHLMKTLKKAFDMASSSFFNILKTLNPDLLIYDFLQPWAPALASSLNIPAVNFLCSSMAMSCFGLNLNKNKEIKFLFPEIYPRDYMEMKLFRVFESSSNQIKDGERAGRCIDQSFHVILAKTFRELEGKYIDYVSVKCNKKIVPVGPLVEDTIHEDDEKTMDHHHHHHDEVIKWLEKKERSTTVFVSFGSEYFLSKEEMEEIAHGLELSKVNFIWVVRFPKGEKINLEESLPEGYLERIQERGKIVEGWAPQRKILGHSSIGGFVSHCGWSSIMESMKLGVPIIAMPMNLDQPINSRIVEAAGVGIEVSRNQSGELEREEMAKTIRKVVVEREGVYVRRKAREMSDVLRKKGEEEIDGVVDELVQLCDMKTNYL

SEQ ID NO: 143 - protein, 452 aa, Cephalotus follicularis
MDLKRRSIRVLMLPWLAHGHISPFLELAKKLTNRNFLIYFCSTPINLNSIKPKLSSKYSFSIQLVELHLPSLPELPPHYHTTNGLPLHLMNTLKTAFDMASPSFLNILKTLKPDLLICDHLQPWAPSLASSLNIPAIIFPTNSAIMMAFSLHHAKNPGEEFPFPSININDDMVKSINFLHSASNGLTDMDRVLQCLERSSNTMLLKTFRQLEAKYVDYSSALLKKKIVLAGPLVQVPDNEDEKIEIIKWLDSRGQSSTVFVSFGSEYFLSKEEREDIAHGLELSKVNFIWVVRFPVGEKVKLEEALPNGFAERIGERGLVVEGWAPQAMILSHSSIGGFVSHCGWSSMMESMKFGVPIIAMPMHIDQPLNARLVEDVGVGLEIKRNKDGRFEREELARVIKEVLVYKNGDAVRSKAREMSEHIKKNGDQEIDGVADALVKLCEMKTNSLNQD

SEQ ID NO: 144 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 145 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 146 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 147 - protein, 485 aa, Stevia rebaudiana
MYNVTYHQNSKAMATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 148 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 149 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 150 - protein, 462 aa, Artificial Sequence
  Synthetic (OsUGT1-2)
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 151 - protein, 490 aa, Arabidopsis thaliana
MGSISEMVFETCPSPNPIHVMLVSFQGQGHVNPLLRLGKLIASKGLLVTFVTTELWGKKMRQANKIVDGELKPVGSGSIRFEFFDEEWAEDDDRRADFSLYIAHLESVGIREVSKLVRRYEEANEPVSCLINNPFIPWVCHVAEEFNIPCAVLWVQSCACFSAYYHYQDGSVSFPTETEPELDVKLPCVPVLKNDEIPSFLHPSSRFTGFRQAILGQFKNLSKSFCVLIDSFDSLEREVIDYMSSLCPVKTVGPLFKVARTVTSDVSGDICKSTDKCLEWLDSRPKSSVVYISFGTVAYLKQEQIEEIAHGVLKSGLSFLWVIRPPPHDLKVETHVLPQELKESSAKGKGMIVDWCPQEQVLSHPSVACFVTHCGWNSTMESLSSGVPVVCCPQWGDQVTDAVYLIDVFKTGVRLGRGATEERVVPREEVAEKLLEATVGEKAEELRKNALKWKAEAEAAVAPGGSSDKNFREFVEKLGAGVTKTKDNGY

SEQ ID NO: 152 - protein, 481 aa, Arabidopsis thaliana
MGSHVAQKQHVVCVPYPAQGHINPMMKVAKLLYAKGFHITFVNTVYNHNRLLRSRGPNAVDGLPSFRFESIPDGLPETDVDVTQDIPTLCESTMKHCLAPFKELLRQINARDDVPPVSCIVSDGCMSFTLDAAEELGVPEVLFWTTSACGFLAYLYYYRFIEKGLSPIKDESYLTKEHLDTKIDWIPSMKNLRLKDIPSFIRTTNPDDIMLNFIIREADRAKRASAIILNTFDDLEHDVIQSMKSIVPPVYSIGPLHLLEKQESGEYSEIGRTGSNLWREETECLDWLNTKARNSVVYVNFGSITVLSAKQLVEFAWGLAATGKEFLWVIRPDLVAGDEAMVPPEFLTATADRRMLASWCPQEKVLSHPAIGGFLTHCGWNSTLESLCGGVPMVCWPFFAEQQTNCKFSRDEWEVGIEIGGDVKREEVEAVVRELMDEEKGKNMREKAEEWRRLANEATEHKHGSSKLNFEMLVNKVLLGE

SEQ ID NO: 153 - protein, 438 aa, Columba livia
MIHCGKKHICAFVTCILISASILMYSWKDPQLQNNITRKIFQATSALPASQLCRGKPAQNVITALEDNRTFIISPYFDDRESKVTRVIGIVHHEDVKQLYCWFCCQPDGKIYVARAKIDVHSDRFGFPYGAADIVCLEPENCNPTHVSIHQSPHANIDQLPSFKIKNRKSETFSVDFTVCISAMFGNYNNVLQFIQSVEMYKILGVQKVVIYKNNCSQLMEKVLKFYMEEGTVEIIPWPINSHLKVSTKWHFSMDAKDIGYYGQITALNDCIYRNMQRSKFVVLNDADEIILPLKHLDWKAMMSSLQEQNPGAGIFLFENHIFPKTVSTPVFNISSWNRVPGVNILQHVHREPDRKEVFNPKKMIIDPRQVVQTSVHSVLRAYGNSVNVPADVALVYHCRVPLQEELPRESLIRDTALWRYNSSLITNVNKVLHQTVL

SEQ ID NO: 154 - protein, 252 aa, Haemophilus ducreyi
MPTLTVAMIVKNEAQDLAECLKTVDGWVDEIVIVDSGSTDDTLKIATQFNAKVYVNSDWQGFGPQRQFAQQYVTSDYVLWLDADERVTPELKASILQAVQHNQKNTVYKVSRLSEIFGKEIRYSGWYPDYVVRLYPTYLAKYGDELVHEKVHYPADSRVEKLQGDLLHFTYKNIHHYLVKSASYAKAWAMQRAKAGKKASLLDGVTHAIACFLKMYLFKAGFLDGKQGFLLAVLSAHSTFVKYADLWDRTRS

SEQ ID NO: 155 - protein, 252 aa, Neisseria gonorrhoeae
MKKVSVLIVAKNEANHIRECIESCRFDKEVIVIDDHSADNTAEIAEGLGAKVFRRHLNGDFGAQKTFAIEQAGGEWVFLIDADERCTPELSDEISKIVRTGDYAAYFVERRNLFPNHPATHGAMRPDSVCRLMPKKGGSVQGKVHETVQTPYPERRLKHFMYHYTYDNWEQYFNKFNKYTSISAEKYREQGKPVSFVRDIILRPIWGFFKIYILNKGFLDGKMGWIMSVNHSYYTMIKYVKLYYLYKSGGKF

SEQ ID NO: 156 - protein, 309 aa, Rhizobium meliloti
MPNETLHIDIGVCTYRRPELAETLRSLAAMNVPERARLRVIVADNDAEPSARALVEGLRPEMPFDILYVHCPHSNISIARNCCLDNSTGDFLAFLDDDETVSGDWLTRLLETARTTGAAAVLGPVRAHYGPTAPRWMRSGDFHSTLPVWAKGEIRTGYTCNALLRRDAASLLGRRFKLSLGKSGGEDTDFFTGMHCAGGTIAFSPEAWVHEPVPENRASLAWLAKRRFRSGQTHGRLLAEKAHGLRQAWNIALAGAKSGFCATAAVLCFPSAARRNRFALRAVLHAGVISGLLGLKEIEQYGAREVTSA

SEQ ID NO: 157 - protein, 861 aa, Rhizobium radiobacter
MCRCGRAVRSRPVCRPGQLVVRRSPRPRSRNHSRCRPLRLSVFPRPHRRVRHHCQRDLRWEPGRWIAVRWKAARSHRRFRRCPFPRQLVWPVRERHRDAGDRRNQRERRRRDAYHEISEPKFRTRKRTESFWMNKAITVIVWLLVSLCVLAIITMPVSLQTHLVATAISLILLATIKSFNGQGAWRLVALGFGTAIVLRYVYWRTTSTLPPVNQLENFIPGFLLYLAEMYSVVMLGLSLVIVSMPLPSRKTRPGSPDYRPTVDVFVPSYNEDAELLANTLAAAKNMDYPADRFTVWLLDDGGSVQKRNAANIVEAQAAQRRHEELKKLCEDLDVRYLTRERNVHAKAGNLNNGLAHSTGELVTVFDADHAPARDFLLETVGYFDEDPRLFLVQTPHFFVNPDPIERNLRTFETMPSENEMFYGIIQRGLDKWNGAFFCGSAAVLRREALQDSDGFSGVSITEDCETALALHSRGWNSVYVDKPLIAGLQPATFASFIGQRSRWAQGMMQILIFRQPLFKRGLSFTQRLCYMSSTLFWLFPFPRTIFLFAPLFYLFFDLQIFVASGGEFLAYTAAYMLVNLMMQNYLYGSFRWPWISELYEYVQTVHLLPAVVSVIFNPGKPTFKVTAKDESIAEARLSEISRPFFVIFALLLVAMAFAVWRIYSEPYKADVTLVVGGWNLLNLIFAGCALGVVSERGDKSASRRITVKRRCEVQLGGSDTWVPASIDNVSVHGLLINIFDSATNIEKGATAIVKVKPHSEGVPETMPLNVVRTVRGEGFVSIGCTFSPQRAVDHRLIADLIFANSEQWSEFQRVRRKKPGLIRGTAIFLAIALFQTQRGLYYLVRARRPAPKSAKPVGAVK

SEQ ID NO: 158 - protein, 315 aa, Streptococcus agalactiae
MIKKIEKDLISVIVPIYNVEDYLVECIESLIVQTYRNIEILLINDGSTDNCATIAKEFSERDCRVIYIEKSNGGLSEARNYGIYHSKGKYLTFVDSDDKVSSDYIANLYNAIQKHDSSIAIGGYLEFYERHNSIRNYEYLDKVIPVEEALLNMYDIKTYGSIFITAWGKLFHKSIFNDLEFALNKYHEDEFFNYKAYLKANSITYIDKPLYHYRIRVGSIMNNSDNVIIARKKLDVLSALDERIKLITSLRKYSVFLQKTEIFYVNQYFRTKKFLKQQSVMFKEDNYIDAYRMYGRLLRKVKLVDKLKLIKNRFF

SEQ ID NO: 159 - protein, 416 aa, Streptococcus pneumoniae
MYTFILMLLDFFQNHDFHFFMLFFVFILIRWAVIYFHAVRYKSYSCSVSDEKLFSSVIIPVVDEPLNLFESVLNRISRHKPSEIIVVINGPKNERLVKLCHDFNEKLENNMTPIQCYYTPVPGKRNAIRVGLEHVDSQSDITVLVDSDTVWTPRTLSELLKPFVCDKKIGGVTTRQKILDPERNLVTMFANLLEEIRAEGTMKAMSVTGKVGCLPGRTIAFRNIVERVYTKFIEETFMGFHKEVSDDRSLTNLTLKKGYKTVMQDTSVVYTDAPTSWKKFIRQQLRWAEGSQYNNLKMTPWMIRNAPLMFFIYFTDMILPMLLISFGVNIFLLKILNITTIVYTASWWEIILYVLLGMIFSFGGRNFKAMSRMKWYYVFLIPVFIIVLSIIMCPIRLLGLMRCSDDLGWGTRNLTE

SEQ ID NO: 160 - protein, 482 aa, Artificial Sequence
  Synthetic (MbUGTc13)
MADAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEATQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 161 - protein, 463 aa, Artificial Sequence
  Synthetic (MbUGTc19)
MANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKAGSGEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKA

SEQ ID NO: 162 - protein, 458 aa, Artificial Sequence; identical to SEQ ID NO: 145
  Synthetic (MbUGT1-3)

SEQ ID NO: 163 - protein, 463 aa, Artificial Sequence
  Synthetic (MbUGT1-2 )
MATKGSSGMSLAERFWLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKDDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAEMIASIADERLEHAETESPAAAGQGRPAAAPTFEVARMKLIR

SEQ ID NO: 164 - protein, 451 aa, Coffea arabica
MENHATFNVLMLPWLAHGHVSPYLELAKKLTARNFNVYLCSSPATLSSVRSKLTEKFSQSIHLVELHLPKLPELPAEYHTTNGLPPHLMPTLKDAFDMAKPNFCNVLKSLKPDLLIYDLLQPWAPEAASAFNIPAVVFISSSATMTSFGLHFFKNPGTKYPYGNAIFYRDYESVFVENLTRRDRDTYRVINCMERSSKIILIKGFNEIEGKYFDYFSCLTGKKVVPVGPLVQDPVLDDEDCRIMQWLNKKEKGSTVFVSFGSEYFLSKKDMEEIAHGLEVSNVDFIWVVRFPKGENIVIEETLPKGFFERVGERGLVVNGWAPQAKILTHPNVGGFVSHCGWNSVMESMKFGLPIIAMPMHLDQPINARLIEEVGAGVEVLRDSKGKLHRERMAETINKVMKEASGESVRKKARELQEKLELKGDEEIDDVVKELVQLCATKNKRNGLHYY

SEQ ID NO: 165 - protein, 483 aa, Stevia rebaudiana
MDQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPVKDETYLTNGYLDMEIDWIPGMKRIRLRDLPEFILATKQNYFAFEFLFETAQLADKVSHMIIHTFEELEASLVSEIKSIFPNVYTIGPLQLLLNKITQKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPAVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 166 - protein, 384 aa, Flavobacteriales bacterium
MLNNSLFSRLEEIPALLKLKLGSKDYYKNNNSETLTCDNLRYCFDTLNKVSRSFATVIKQLPNELGNNVCVFYLILRALDSIEDDMNLPKELKIKLLREFHKKNYESGWNISGVGDKKEHVELLENYDKVIQSFLAIDQKNQLIITDICRKVGAGMANFVKAEIESVEDYNLYCHHVAGLVGIGLSRMFISSGLENDDFLNQDEISNSMGLFLQKTNIVRDYREDLDEGRMFWPKDIWHVYGSKINDFAINPTHDQSVLCLNHMLNNALTHATDCLAYLKHLRNENIFKFCAIPQVMAMATLCKIYSNPDVFIKNVKIRKGLAAKLILNTTSMDEVIKVYKDMLLVIESKISSDNNPVSAETIQLLKQIREYFNDETLIVRKIA

SEQ ID NO: 167 - protein, 383 aa, Bacteroidetes bacterium
MLNSSLFSRLEEIPALLKLKLGSINNYKNNNSENLTSKNLRYCFDTLNKVSRSFASVIKQLPNELMVNVCLFYLILRALDSIEDDMNLPKDFKINLLREFLDKNYEPGWKISGVGDKKEYVELLENYDKVIQVFLDIDPKNQLIITDICRKMGAGMAHFVEAEINSVKDYNLYCYHVAGLVGIGLSKMFLASGLENCDYLNQEEISSSMGLFLQKTNIVRDYKEDMEENRIFWPKEIWRTYASKFSDFSINPQHETSISCLNHMVNDALGHVIDCLEYLRHLRNENIFKFCAIPQVMAMATLCKVYNNPDVFIKTVKIRKGLAAKLILNTTSMDEVIKVYKGLLLDIENKIPLHNPTSDETLRLIKNIRSYCNNETMVVSKTA

SEQ ID NO: 168 - protein, 458 aa, Bathymodiolus azoricus Endosymbiont
MHTTSEHNDLFDICIVGAGMAGATIATYLAPRGIKIALIDRDYAEKRRIVGELLQPGAVQTLKKMGLEHLLEGFDAQPIYGYALFNKDCEFSIEYNQDKSTNYRGVGLHNGRFLQKIREDALKQPSITQIHGTVSELIEDENHVVTGVKYKEKYTRELKTVNAKLTITSDGFFSSFRKDLTNNVKTVTSFFVGIILKDCELPYPHHGHVFLSAPTPFICYPISSTESRLLIDFPGDQAPKKEAVKHHIENNVIPFLPKEFRLCLDQALRENDYKIMPNHYMPAKPVLKKGVVLLGDALNMRHPITGGGLTAVFNDVYLLSTHLLAMPDFNDTKLIHEKVNLYYNDRYHANTNVNIMANALYGVMSNDLLKQSVFEYLRKGGDNSGGPISLLAGLNRNPTILIKHFFSVALLCLRNLFKAHKMSLTNAFYVIKDAFCIIVPLAINELRPSSFLKKNIHN

SEQ ID NO: 169 - protein, 458 aa, Methyloprofundus sediment
MNTSPEHNDLFDICIVGVGMAGATIAAYLAPRGLKIALIDREYTEKRRIVGELLQPGAVQTLKKMGLEHLLEGFDAQPIYGYALFNNDKEFSISYNSDDSTEYHGVGLHNGRFLQKIREDVFKNETVTQIHGTVSELIEDKKGVVKGVTYREKHTREYKTVKAKLTVTSDGFFSNFRKDLSNNVKTVTSFFIGLVLNDCNLPFPNHGHVFLSAPTPFICYPISSTETRLLIDYPGDKAPKKDEIREHILNKVAPFLPEEFKECFANAMEDDDFKVMPNHYMPAKPVLKEGAVLLGDALNMRHPLTGGGLTAVFNDVYLLSTHLLAMPDFNDPKLLHEKLELYYQDRYHANTNVNIMANALYGVMSNDLLKQGVFEYLRKGGDNSGGPITLLAGLNRNPTLLIKHFFSVAFLCICNLSGNNKMNFTNVFRVMKDAFCIIKPLAVNELRPSSFYKKNIQL

SEQ ID NO: 170 - protein, 448 aa, Methylomicrobium buryatense
MESNFDICIIGAGMAGATIAAYLAPKGINIALIDHCYKEKKRIVGELLQPGAVLSLEQLGLGHLLDGIDAQPVEGYALLQGNEQTTIPYPSPNHGMGLHNGRFLQQIRASALQNSSVTQIQGKALSLLENEQNEIIGVNYRDSVSNEIKSIYAPLTITSDGFFSNFRELLSNNEKTVTSYFIGLILKDCEIPVPKHGHVFLSGPTPFICYPISSNEVRLLIDFPGGQFPRKAFLQAHLETNVTPYIPEGMQTSYRHALQEDRLKVMPNHYMAAKPKIRKGAVMLGDALNMRHPLTGGGLTAVFSDIEILSGHLLAMPDFNNNDLIYQKIEAYYRDRQYANANLNILANALYGVMSNELLKNSVFKYLQRGGVNAKESIAILAGLNKNHYSLMKQFFFVALFGAYTLVRENITNLPKATKILSDALTIIKPLAKNELSLVGIFSDYFKR

The invention claimed is:

1. A method for making a triterpenoid, comprising:
providing a recombinant microbial host cell expressing a heterologous enzyme pathway catalyzing the conversion of isopentenyl pyrophosphate (IPP) and dimethylallyl pyrophosphate (DMAPP) to one or more triterpenoids, the pathway comprising:
a farnesyl diphosphate synthase (FPPS),
a squalene synthase (SQS), wherein the SQS comprises an amino acid sequence that is at least 85% identical to the amino acid sequence of SEQ ID NO: 11;
a squalene epoxidase (SQE), wherein the squalene epoxidase comprises an amino acid sequence that is at least 85% identical to SEQ ID NO: 39; and
culturing the host cell at a temperature within the range of 28° C. to 37° C., and under conditions for producing the triterpenoid;
wherein the microbial host cell is a bacterium or yeast.

2. The method of claim 1, wherein the SQS comprises an amino acid sequence that is at least 90% identical to SEQ ID NO: 11.

3. The method of claim 2, wherein the SQS comprises an amino acid sequence that is at least 95% identical to SEQ ID NO: 11.

4. The method of claim 2, wherein the SQS comprises an amino acid sequence having from 1 to 20 amino acid modifications with respect to SEQ ID NO: 11, the amino acid modifications being independently selected from amino acid substitutions, deletions, and insertions.

5. The method of claim 1, wherein the microbial host cell is a bacterium.

6. The method of claim 5, wherein the microbial host cell is *E. coli*.

7. The method of claim 6, wherein the *E. coli* produces increased MEP pathway products, and has an overexpression of one or more MEP pathway enzymes.

8. The method of claim 1, wherein the squalene epoxidase comprises an amino acid sequence that is at least 90% identical to SEQ ID NO: 39.

9. The method of claim 1, wherein the host cell is *E. coli* that coexpresses an SQS enzyme comprising an amino acid sequence that is at least 90% identical to the amino acid sequence of SEQ ID NO: 11, and a squalene epoxidase comprising an amino acid sequence that is at least 90% identical to the amino acid sequence of SEQ ID NO: 39.

10. The method of claim 1, wherein the heterologous enzyme pathway further comprises a triterpene cyclase.

11. The method of claim 10, wherein the heterologous enzyme pathway further comprises an epoxide hydrolase (EPH).

12. The method of claim 11, wherein the heterologous pathway further comprises one or more oxidases.

13. The method of claim 12, wherein at least one oxidase is a cytochrome P450 enzyme.

14. The method of claim 12, wherein the heterologous enzyme pathway produces mogrol.

15. The method of claim 14, wherein the heterologous enzyme pathway further comprises one or more uridine diphosphate-dependent glycosyltransferase (UGT) enzymes, thereby producing one or more mogrol glycosides.

16. The method of claim 15, wherein the one or more mogrol glycosides are selected from Mog. II-E, Mog. III-A-2, Mog. III-E, Mog. IIIx, Mog. IV-A, Mog. IV-E, Siamenoside, Isomog. IV, and Mog. V.

17. The method of claim 9, wherein the *E. coli* produces increased MEP pathway products, and has an overexpression of one or more MEP pathway enzymes.

* * * * *